(12) United States Patent
Johnson et al.

(10) Patent No.: US 11,685,779 B2
(45) Date of Patent: Jun. 27, 2023

(54) RECOMBINANT POLYCLONAL PROTEINS TARGETING COVID-19 AND METHODS OF USE THEREOF

(71) Applicant: GigaGen, Inc., South San Francisco, CA (US)

(72) Inventors: David Scott Johnson, San Francisco, CA (US); Sheila Keating, South San Francisco, CA (US); Adam Shultz Adler, Belmont, CA (US); Michael Asensio, South San Francisco, CA (US); Kacy Stadtmiller, San Francisco, CA (US); Emily Benzie, San Francisco, CA (US); Ariel Niedecken, Sunnyvale, CA (US); Angelica V. Medina-Cucurella, Mountain View, CA (US); Rena Aviva Mizrahi, Pacifica, CA (US); Yoong Wearn Lim, South San Francisco, CA (US)

(73) Assignee: GigaGen, Inc., San Carlos, CA (US)

( * ) Notice: Subject to any disclaimer, the term of this patent is extended or adjusted under 35 U.S.C. 154(b) by 0 days.

(21) Appl. No.: 17/386,504

(22) Filed: Jul. 27, 2021

(65) Prior Publication Data
US 2022/0041715 A1  Feb. 10, 2022

Related U.S. Application Data

(63) Continuation of application No. PCT/US2021/037232, filed on Jun. 14, 2021.

(60) Provisional application No. 63/061,721, filed on Aug. 5, 2020, provisional application No. 63/038,470, filed on Jun. 12, 2020.

(51) Int. Cl.
| | |
|---|---|
| *C07K 16/28* | (2006.01) |
| *A61P 31/14* | (2006.01) |
| *C40B 40/10* | (2006.01) |
| *A61K 39/00* | (2006.01) |

(52) U.S. Cl.
CPC .......... *C07K 16/2803* (2013.01); *A61P 31/14* (2018.01); *C40B 40/10* (2013.01); *A61K 2039/505* (2013.01); *C07K 2317/565* (2013.01); *C07K 2317/92* (2013.01)

(58) Field of Classification Search
CPC ........ A61K 2039/505; C07K 2317/565; C07K 2317/622; C07K 2317/92; C07K 16/10; C12N 15/1037; A61P 31/14; C40B 40/10
See application file for complete search history.

(56) References Cited

U.S. PATENT DOCUMENTS

| | | | |
|---|---|---|---|
| 2004/0009168 A1* | 1/2004 | Kaisheva | C07K 16/2809 424/141.1 |
| 2010/0310558 A1 | 12/2010 | Oleksiewicz et al. | |
| 2018/0258422 A1 | 9/2018 | Johnson et al. | |

FOREIGN PATENT DOCUMENTS

| | | |
|---|---|---|
| WO | WO 2004/061104 A2 | 7/2004 |
| WO | WO 2009/030237 A2 | 3/2009 |
| WO | WO 2016/200577 A1 | 12/2016 |
| WO | WO 2018/170013 A1 | 9/2018 |
| WO | WO 2020/223573 A2 | 11/2020 |
| WO | WO 2021/253002 A1 | 12/2021 |
| WO | WO 2022/031834 A1 | 2/2022 |

OTHER PUBLICATIONS

Paul, Fundamental Immunology, 3rd Edition, 1993, pp. 292-295.*
Rudikoff et al., Proc. Natl. Acad. Sci. USA, 1982, 79(6):1979-1983.*
Colman, Research in Immunology, 1994, 145:33-36.*
Bendig, Methods: A Companion to Methods in Enzymology, 1995; 8:83-93.*
Khantasup et al., Monoclonal Antibodies in Immunodiagnosis and Immunotherapy, 2015, 34(6): 404-417.*
Murphy et al., Journal of Immunological Methods, vol. 463, p. 127-133, 2018.*
Lou et al., Cross-neutralization antibodies against SARS-CoV-2 and RBD mutations from convalescent patient antibody libraries, bioRxiv, posted on Jun. 6, 2020, 32 pages.*
Yuan et al., Isolation of and Characterization of Neutralizing Antibodies to Covid-19 from a Large Human Naïve scFv Phage Display Library, bioRxiv, posted on May 19, 2020, 15 pages.*
Ravichandran et al., Antibody repertoire induced by SARS-CoV-2 spike protein immunogens, bioRxiv, posted on May 13, 2020, 34 pages.*
Chi et al., Science, 369: 650-655. (Year: 2020).*
Wang et al., Nat Biotechnol, 36(2), 152-155. author manuscript 14 pages (Year: 2018).*
Adler, A.S. et al. "Rare, high-affinity anti-pathogen antibodies from human repertoires, discovered using microfluidics and molecular genomics," *mAbs*, Sep. 22, 2017, vol. 9, Iss. 8, pp. 1282-1296.
Ferrara, F. et al., "Recombinant renewable polyclonal antibodies," *mAbs*, Jan. 14, 2015, vol. 7, Iss. 1, pp. 32-41.
International Search Report and Written Opinion, Patent Cooperation Treaty Application No. PCT/US2020/030878, dated Dec. 21, 2020, 13 pages.

(Continued)

*Primary Examiner* — Hong Sang
(74) *Attorney, Agent, or Firm* — Fenwick & West LLP

(57) ABSTRACT

Provided herein are compositions comprising recombinant polyclonal proteins (RPPs) derived from mammalian plasma cells and plasmablasts. Also provided are methods of using the RPPs.

10 Claims, 117 Drawing Sheets
Specification includes a Sequence Listing.

(56) References Cited

OTHER PUBLICATIONS

Keating, S.M. et al., "Capturing and Recreating Diverse Antibody Repertoires as Multivalent Recombinant Polyclonal Antibody Drugs," bioRxiv, preprint, Aug. 6, 2020, 78 pages.
Keating, S.M. et al., "Generation of recombinant hyperimmune globulins from diverse B-cell repertoires," *nature biotechnology*, vol. 39, Aug. 2021, pp. 989-999.
Reason, D.C. et al. "Human Fab Fragments Specific for the *Haemophilus influenzae b* Polysaccharide Isolated from a Bacteriophage Combinatorial Library Use Variable Region Gene Combinations and Express an Idiotype That Mirrors In Vivo Expression," *Infection and Immunity*, Jan. 1997, vol. 65, No. 1, pp. 261-266.
Bloch et al., "Deployment of convalescent plasma for the prevention and treatment of COVID-19," the Journal of Clinical Investigation, vol. 130, No. 6, Jun. 1, 2020 (Jun. 1, 2020), pp. 2757-2765, XP055815868, GB ISSN: 0021-9738, DOI: 10.1172/JCI138745.
Branche, E. et al., "Human Polyclonal Antibodies Prevent Lethal Zika Virus Infection in Mice", *Scientific Reports*, vol. 9, Article No. 9857, Jul. 8, 2019 (Jul. 8, 2019), pp. 1-12, XP055664845.
Cross, "Searching for a coronavirus cure in the blood," Chemical & Engineering New, Apr. 7, 2020 (Apr. 7, 2020), XP055850922, 7 pages, Retrieved from the Internet: URL:https://cen.acs.org/pharmaceuticals/biologics/Searching-coronavirus-cure-blood/98/i14 [retrieved on Oct. 13, 2021].
Frandsen, T.P. et al., "Consistent manufacturing and quality control of a highly complex recombinant polyclonal antibody product for human therapeutic use", Biotechnology and Bioengineering, vol. 108, Issue 9, Sep. 2011, pp. 2171-2181, XP071108999.
Gigagen Press Release, "COVID-19 Antibody Therapy: GigaGen Initiates Development of rCIG," Outbreak News Today, Mar. 30, 2020 (Mar. 30, 2020), 4 pages, XP055850665, Retrieved from the Internet: URL:http://outbreaknewstoday.com/covid-19-antibody-therapy-gigagen-initiates-development-of-rcig-21518/ [retrieved on Oct. 12, 2021].
Goldstein et al., "Massively parallel single-cell B-cell receptor sequencing enables rapid discovery of diverse antigen-reactive antibodies," *Communications Biology*, vol. 2, Article No. 304, Aug. 9, 2019 (Aug. 9, 2019), pp. 1-10, XP055758874, DOI: 10.1038/s42003-019-0551-y.
Hammarström et al., "Development of passive immunity against SARS-CoV-2 for management of immunodeficient patients—a perspective," Journal of Allergy and Clinical Immunology, Elsevier, Amsterdam, NL, vol. 146, No. 1, May 12, 2020 (May 12, 2020), pp. 58-60, P086207336, ISSN: 0091-6749, DOI: 10.1016/J.JACI.2020.04.043 [retrieved on May 12, 2020].
International Preliminary Reporton Patentability, Patent Cooperation Treaty Application No. PCT/US2020/030878, dated Nov. 2, 2021, 8 pages.
International Search Report and Written Opinion, Patent Cooperation Treaty Application No. PCT/US2021/037232, dated Nov. 8, 2021, 16 pages.
International Search Report and Written Opinion, Patent Cooperation Treaty Application No. PCT/US2021/044523, dated Nov. 18, 2021, 19 pages.
Shen et al., "Treatment of 5 Critically Ill Patients With COVID-19 With Convalescent Plasma," JAMA the Journal of the American Medical Association, vol. 323, No. 16, Mar. 27, 2020 (Mar. 27, 2020), p. 1582-1589, XP055725009, US ISSN: 0098-7484, DOI: 10.1001/jama.2020.4783.
Sheridan, "Convalescent serum lines up as first-choice treatment for coronavirus," Nature Biotechnology, Gale Group Inc, New York, vol. 38, No. 6, May 1, 2020 (May 1, 2020), pp. 655-658, XP037167671, ISSN: 1087-0156, DOI: 10.1038/D41587-020-00011-1 [retrieved on May 1, 2020].
Tanno et al. "A facile technology for the high-throughput sequencing of the paired VH:VL and TCRβ:TCRα repertoires," *Science Advances*, Apr. 22, 2020, vol. 6, Issue 17, 8 pages, XP55851688, Retrieved from the Internet: URL:https://www.science.org/doi/pdf/10.1126/sciadv.aay9093 [retrieved on Oct. 15, 2021].
Tiberghien et al., "Collecting and evaluating convalescent plasma for COVID-19 treatment: why and how?", Vox Sanguinis, vol. 115, No. 6, May 3, 2020 (May 3, 2020), pp. 488-494, XP055815870, CH ISSN: 0042-9007, DOI: 10.1111/vox.12926.
World Health Organization, "Landscape analysis of therapeutics as Feb. 17, 2020," Feb. 25, 2020 (Feb. 25, 2020), XP055809736, Retrieved from the Internet: URL:https://web.archive.org/web/20200225223659/https://www.who.int/blueprint/priority-diseases/key-action/Table_of_therapeutics_Appendix_17022020.pdf?ua=1, pp. 26,28.
Partial Supplementary European Search Report, European Patent Application No. 20799387.7, dated Jan. 4, 2023, 12 pages.
United States Office Action, U.S. Appl. No. 17/469,493, dated Dec. 30, 2022, 11 pages.
Wang, Q., et al., "Molecular determinants of human neutralizing antibodies isolated from a patient infected with Zika virus," Science Translational Medicine, Dec. 14, 2016, vol. 8, issue 369, 10 pages.

\* cited by examiner

| GigaGen donor ID | Race | Sex | Age | Symptoms | Date of symptoms onset | Days between symptoms onset and blood draw | Presumed/ Confirmed | Spike antigen EC50 (mg/ml) | Spike antigen peak OD signal | RBD antigen EC50 (mg/ml) | RBD antigen peak OD signal | Library ID | PBMC CoV-2 RNA qPCR |
|---|---|---|---|---|---|---|---|---|---|---|---|---|---|
| CSS-1902 | AA | Male | 67 | Fever, SOB | 2/28/20 | 32 | Confirmed | 0.0056 | 3.15 | 0.039 | 2.46 | Library 1 | Negative |
| CSS-1905 | White | Male | 71 | Fever, Cough, SOB | 3/16/20 | 15 | Presumed | 0.019 | 3.22 | 0.12 | 2.34 | Library 1 | Negative |
| CSS-1907 | AA | Female | 66 | Fever, Cough | 3/14/20 | 17 | Presumed | 0.063 | 2.98 | 0.091 | 1.41 | Library 2 | Negative |
| CSS-1911 | White | Female | 61 | Fever, ST, SOB | 3/9/20 | 22 | Presumed | 0.10 | 2.80 | 0.13 | 0.75 | Library 2 | Negative |
| CSS-1921 | White | Female | 30 | Fever, ST, Cough, SOB | 3/17/20 | 15 | Confirmed | 0.021 | 2.95 | 0.11 | 1.81 | Library 3 | Negative |
| CSS-1920 | White | Female | 57 | Fever, Cough, SOB | 3/16/20 | 16 | Confirmed | 0.022 | 2.81 | 0.066 | 1.52 | Library 3 | Negative |
| CSS-1928 | White | Female | 63 | Fever, Cough | 3/14/20 | 19 | Presumed | 0.025 | 2.95 | 0.076 | 1.96 | Library 4 | Negative |
| CSS-1924 | White | Female | 31 | Fever, Cough, SOB | 3/21/20 | 12 | Confirmed | 0.16 | 2.63 | 0.23 | 2.30 | Library 4 | Negative |
| CSS-1944 | White | Female | 49 | Fever, ST, Cough, Pneumonia | 3/15/20 | 24 | Confirmed | 0.014 | 3.21 | 0.053 | 2.17 | Library 5 | Negative |
| CSS-1943 | White | Female | 52 | ST, Cough, SOB | 3/16/20 | 23 | Confirmed | 0.014 | 3.15 | 0.067 | 1.85 | Library 5 | Negative |
| CSS-1937 | White | Female | 35 | Fever, ST, Cough, SOB | 3/17/20 | 21 | Confirmed | 0.009 | 3.17 | 0.027 | 1.71 | Library 6 | Negative |
| CSS-1936 | White | Female | 23 | Fever, Cough, SOB | 3/7/20 | 31 | Confirmed | 0.011 | 3.16 | 0.088 | 2.01 | Library 6 | Negative |
| CSS-1901 | White | Male | 67 | Fever, Cough | 3/15/20 | 16 | Confirmed | 0.010 | 3.09 | 0.085 | 2.37 | Library 7 | Negative |
| CSS-1940 | White | Female | 40 | Fever, Cough | 3/18/20 | 21 | Confirmed | 0.012 | 3.07 | 0.057 | 1.99 | Library 7 | Negative |

FIG. 3A

| GigaGen donor ID | Race | Sex | Age | Symptoms | Date of symptoms onset | Days between symptoms onset and blood draw | Presumed/ Confirmed | Spike antigen EC50 (mg/ml) | Spike antigen peak OD signal | RBD antigen EC50 (mg/ml) | RBD antigen peak OD signal | Library ID | PBMC CoV-2 RNA qPCR |
|---|---|---|---|---|---|---|---|---|---|---|---|---|---|
| CSS-1939 | White | Female | 24 | Fever, ST, Cough, SOB | 3/8/20 | 30 | Confirmed | 0.037 | 3.10 | 0.073 | 1.37 | Library 8 | Negative |
| CSS-1949 | White | Male | 47 | Fever, Cough | 3/21/20 | 19 | Confirmed | 0.13 | 2.79 | 0.32 | 2.32 | Library 8 | Negative |
| CSS-1945 | White | Female | 31 | Fever, ST, Cough, SOB | 3/20/20 | 19 | Confirmed | 0.051 | 3.09 | 0.15 | 1.03 | | |
| CSS-1931 | White | Female | 35 | Fever, ST, Cough, SOB | 3/24/20 | 13 | Confirmed | 0.11 | 2.45 | 0.27 | 1.22 | | |
| CSS-1933 | White | Female | 43 | Fever, Cough | 2/25/20 | 42 | Confirmed | 0.13 | 3.23 | 0.27 | 1.16 | | |
| CSS-1932 | White | Female | 33 | Fever, SOB | 3/18/20 | 20 | Confirmed | 0.13 | 3.09 | 0.11 | 1.05 | | |
| CSS-1935 | White | Female | 45 | ST, Cough, SOB | 3/22/20 | 16 | Confirmed | 0.16 | 3.07 | 0.14 | 1.22 | | |
| CSS-1948 | White | Female | 45 | Fever, Cough, SOB | 3/25/20 | 15 | Confirmed | 0.17 | 2.64 | 0.091 | 0.97 | | |
| CSS-1938 | White | Female | 37 | Fever, ST, Cough, SOB | 3/22/20 | 16 | Confirmed | 0.20 | 3.20 | 0.25 | 0.82 | | |
| CSS-1929 | AA | Male | 49 | Fever, Cough, SOB | 2/28/20 | 34 | Presumed | 0.23 | 0.92 | 0.041 | 1.31 | | |
| CSS-1922 | White | Male | 54 | Fever, Cough, SOB | 2/28/20 | 34 | Presumed | 0.24 | 0.34 | 0.14 | 0.45 | | |
| CSS-1914 | White | Female | 65 | Fever, Cough, SOB | 2/26/20 | 35 | Presumed | 0.37 | 1.54 | 0.39 | 2.76 | | |
| CSS-1925 | White | Male | 63 | Fever, Cough, SOB, ST | 3/10/20 | 23 | Presumed | 0.65 | 0.68 | 0.17 | 0.75 | | |
| CSS-1946 | White | Female | 50 | ST, Cough | 3/19/20 | 21 | Confirmed | 0.67 | 2.50 | 0.69 | 1.66 | | |
| CSS-1930 | White | Female | 47 | Fever, Cough | 3/10/20 | 23 | Presumed | 0.69 | 0.45 | 1.29 | 0.94 | | |

FIG. 3B

| GigaGen donor ID | Race | Sex | Age | Symptoms | Date of symptoms onset | Days between symptoms onset and blood draw | Presumed/ Confirmed | Spike antigen EC50 (mg/ml) | Spike antigen peak OD signal | RBD antigen EC50 (mg/ml) | RBD antigen peak OD signal | Library ID | PBMC CoV-2 RNA qPCR |
|---|---|---|---|---|---|---|---|---|---|---|---|---|---|
| CSS-1934 | White | Female | 42 | Fever, ST, Cough | 3/21/20 | 17 | Confirmed | 0.75 | 3.17 | 0.74 | 1.11 | | |
| CSS-1926 | White | Female | 59 | Fever, Cough, SOB, ST | 3/8/20 | 25 | Presumed | 0.77 | 0.55 | 0.70 | 0.80 | | |
| CSS-1915 | White | Male | 59 | Fever, ST, SOB | 3/11/20 | 21 | Presumed | 0.83 | 0.81 | 0.61 | 0.85 | | |
| CSS-1941 | White | Female | 69 | ST, Cough | 3/11/20 | 28 | Confirmed | 0.91 | 2.93 | 0.55 | 0.94 | | |
| CSS-1917 | White | Male | 67 | Fever, Cough | 3/10/20 | 22 | Presumed | 0.91 | 0.64 | 0.69 | 0.77 | | |
| CSS-1904 | White | Female | 20 | Fever, ST, Cough | 3/11/20 | 20 | Confirmed | 0.96 | 0.64 | 0.63 | 0.86 | | |
| CSS-1916 | White | Male | 70 | Fever, SOB | 2/27/20 | 34 | Presumed | 1.00 | 0.69 | 0.15 | 1.00 | | |
| CSS-1947 | AA | Female | 52 | Fever, Cough | 3/21/20 | 19 | Confirmed | 1.25 | 2.68 | 0.81 | 0.99 | | |
| CSS-1918 | White | Female | 59 | Fever, Cough, SOB | 3/2/20 | 30 | Presumed | 1.32 | 1.55 | 0.38 | 0.91 | | |
| CSS-1923 | White | Female | 57 | Fever, Cough | 2/25/20 | 37 | Presumed | 1.33 | 0.62 | 0.92 | 1.35 | | |
| CSS-1919 | White | Female | 53 | Fever, ST, SOB | 3/13/20 | 19 | Confirmed | 1.34 | 0.80 | 0.30 | 0.76 | | |
| CSS-1913 | White | Female | 57 | Fever, Cough | 3/5/20 | 26 | Presumed | 1.47 | 1.69 | 0.23 | 0.88 | | |
| CSS-1927 | AA | Female | 55 | Cough, ST | 3/2/20 | 31 | Presumed | 1.60 | 0.92 | 0.72 | 1.18 | | |
| CSS-1909 | White | Female | 70 | Fever, Cough, SOB | 2/25/20 | 35 | Presumed | 1.88 | 0.92 | 0.13 | 0.75 | | |
| CSS-1912 | White | Female | 46 | Fever, Cough, SOB | 3/8/20 | 23 | Confirmed | 2.20 | 0.76 | 0.10 | 0.67 | | |
| CSS-1906 | White | Male | 58 | Fever, ST, SOB, Cough | 2/25/20 | 35 | Presumed | 2.59 | 1.28 | 1.46 | 1.31 | | |
| CSS-1908 | White | Female | 57 | Fever, Cough, SOB | 2/24/20 | 36 | Presumed | 2.60 | 0.82 | 0.46 | 0.72 | | |

FIG. 3C

| GigaGen donor ID | Race | Sex | Age | Symptoms | Date of symptoms onset | Days between symptoms onset and blood draw | Presumed/ Confirmed | Spike antigen EC50 (mg/ml) | Spike antigen peak OD signal | RBD antigen EC50 (mg/ml) | RBD antigen peak OD signal | Library ID | PBMC CoV-2 RNA qPCR |
|---|---|---|---|---|---|---|---|---|---|---|---|---|---|
| CSS-1910 | White | Female | 25 | Fever, ST, Cough, SOB | 3/4/20 | 27 | Presumed | 2.84 | 1.27 | 1.12 | 1.23 | | |
| CSS-1942 | White | Female | 39 | Fever, Cough | 3/24/20 | 15 | Confirmed | 2.89 | 2.03 | 1.88 | 2.31 | | |
| CSS-1903 | White | Female | 52 | Fever, Cough, SOB, Fatigue | 3/1/20 | 30 | Presumed | 3.47 | 0.84 | 1.25 | 0.99 | | |
| CSS-1900 | White | Female | 69 | Fever, Cough | 3/6/20 | 25 | Presumed | 9.94 | 0.73 | 3.11 | 1.00 | | |
| GAMUNEX CIVIG | n/a | n/a | n/a | n/a | n/a | n/a | n/a | 1.41 | 1.99 | 1.27 | 2.26 | | |

FIG. 3D

| Assay | Category | Requirement |
|---|---|---|
| Anti-HLA | Safety | Comparable to or better than plasma-derived IVIG |
| Agglutination | Safety | Comparable to or better than plasma-derived IVIG |
| Human tissue microarrays | Safety | No detectable binding at physiologically relevant concentration |
| Anti-complement | Safety | Comparable to or better than plasma-derived IVIG |
| Spike:ACE2-inhibition ELISA | Potency | >5,000-fold better than plasma-derived IVIG |
| Live virus neutralization | Potency | >5,000-fold better than plasma-derived IVIG |
| Pseudotype virus neutralization | Potency | >5,000-fold better than plasma-derived IVIG |
| Antibody RNA-seq | Diversity | >1,000 antibodies |

FIG. 5

| Sample / Library | S1 binding EC$_{50}$ (mg/ml) | S1 binding fold over serum | RBD binding EC$_{50}$ (mg/ml) | RBD binding fold over serum | Plate-based neutralization IC$_{50}$ (mg/ml) | Plate-based neutralization over serum | Pseudotype neutralization IC$_{50}$ (mg/ml) | Pseudotype neutralization over serum | Anti-RBC (agglutination) | Anti-HLA | % RBD-specific scFv (1st yeast sort) | # antibodies (2nd yeast sort) |
|---|---|---|---|---|---|---|---|---|---|---|---|---|
| GAMUNEX-C IVIG | 1.41 | --- | 1.27 | --- | 114 | --- | No neutralization | --- | --- | --- | --- | --- |
| SARS-CoV-2 mAb | 0.00012 | --- | 0.0001 | --- | 0.75 | --- | Not tested | --- | --- | --- | --- | --- |
| Library 1 | 0.00017 | 147.1 | 0.00013 | 192.3 | 0.0026 | 269.2 | 0.00044 | 36.4 | Negative | Negative | 1.02% | 149 |
| Library 1 serum pool | 0.025 | 1.0 | 0.025 | 1.0 | 0.7 | 1.0 | 0.016 | 1.0 | --- | --- | --- | --- |
| Library 2 | 0.00037 | 297.3 | 0.00018 | 722.2 | 0.0053 | 241.5 | 0.0044 | 206.8 | Negative | Negative | 0.57% | 167 |
| Library 2 serum pool | 0.11 | 1.0 | 0.13 | 1.0 | 1.28 | 1.0 | 0.91 | 1.0 | --- | --- | --- | --- |
| Library 3 | 0.00016 | 337.5 | 0.000047 | 723.4 | 0.0021 | 128.6 | 0.0018 | 31.1 | Negative | In progress | 1.60% | 123 |
| Library 3 serum pool | 0.054 | 1.0 | 0.034 | 1.0 | 0.27 | 1.0 | 0.056 | 1.0 | --- | --- | --- | --- |
| Library 4 | 0.00014 | 392.9 | 0.00015 | 366.7 | 0.0016 | 1500.0 | 0.0011 | 32.7 | Negative | negative | 0.42% | 209 |
| Library 4 serum pool | 0.055 | 1.0 | 0.055 | 1.0 | 2.4 | 1.0 | 0.036 | 1.0 | --- | --- | --- | --- |
| Library 5 | 0.00019 | 263.2 | 0.000061 | 344.3 | 0.0017 | 164.7 | 0.00082 | 60.0 | Negative | In progress | 2.29% | 140 |
| Library 5 serum pool | 0.05 | 1.0 | 0.021 | 1.0 | 0.28 | 1.0 | 0.049 | 1.0 | --- | --- | --- | --- |
| Library 6 | 0.00013 | 307.7 | 0.000054 | 314.8 | 0.0018 | 194.4 | 0.00034 | 115.3 | Negative | In progress | 0.95% | 108 |
| Library 6 serum pool | 0.04 | 1.0 | 0.017 | 1.0 | 0.35 | 1.0 | 0.039 | 1.0 | --- | --- | --- | --- |
| Library 7 | 0.00011 | 290.9 | 0.000044 | 218.2 | 0.0023 | 139.1 | 0.00032 | 74.4 | Negative | In progress | 1.37% | 83 |
| Library 7 serum pool | 0.032 | 1.0 | 0.0096 | 1.0 | 0.32 | 1.0 | 0.024 | 1.0 | --- | --- | --- | --- |
| Library 8 | 0.000038 | 1394.7 | 0.000027 | 592.6 | 0.000014 | 2500.0 | 0.00017 | 361.4 | Negative | In progress | 0.88% | 122 |
| Library 8 serum pool | 0.053 | 1.0 | 0.016 | 1.0 | 0.35 | 1.0 | 0.061 | 1.0 | --- | --- | --- | --- |

FIG. 6

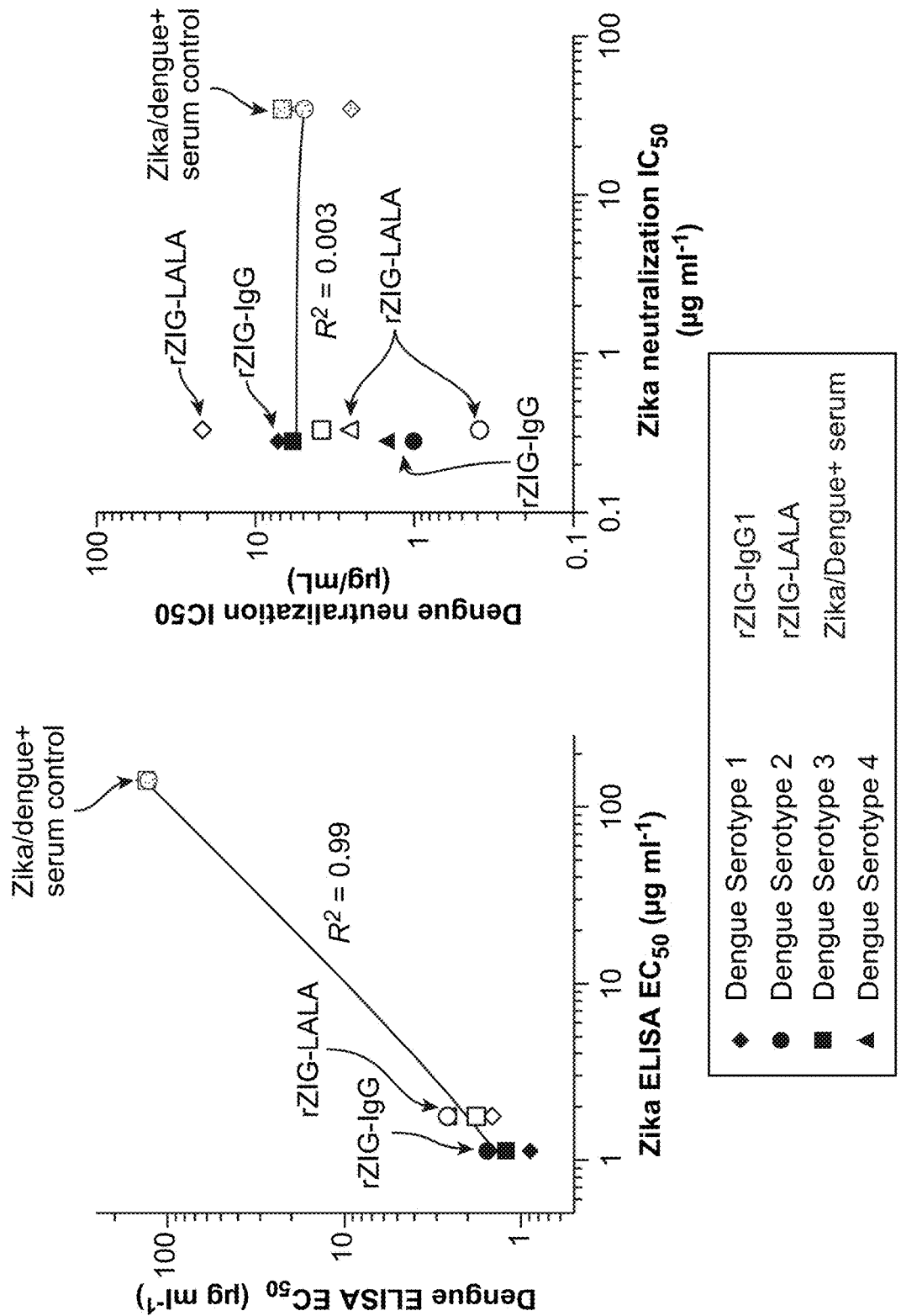

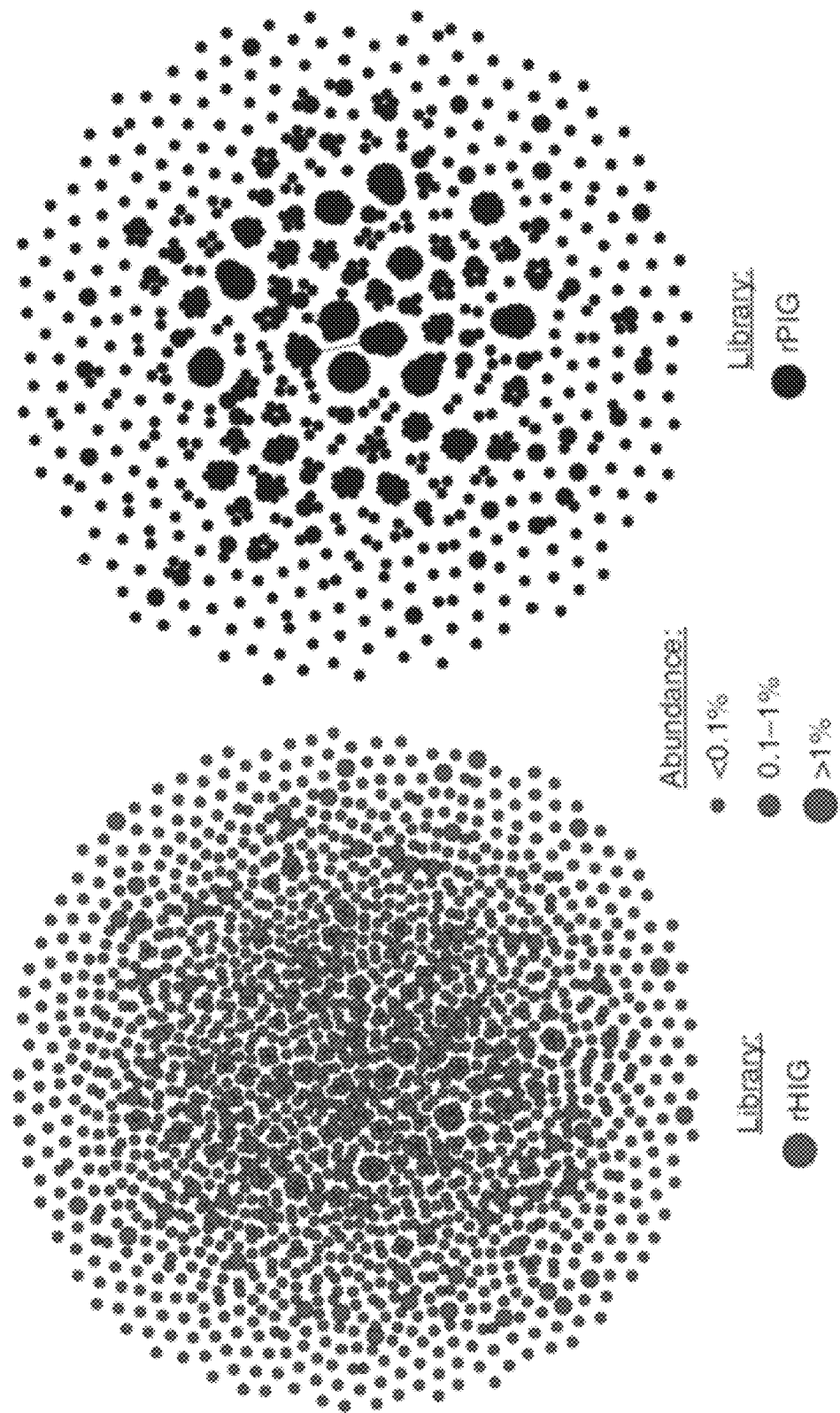

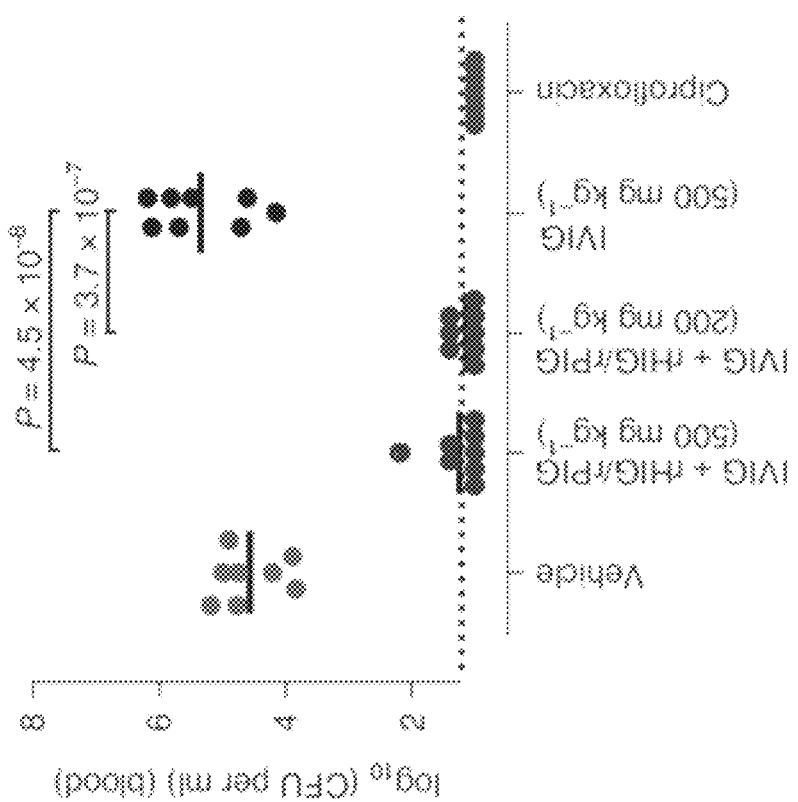
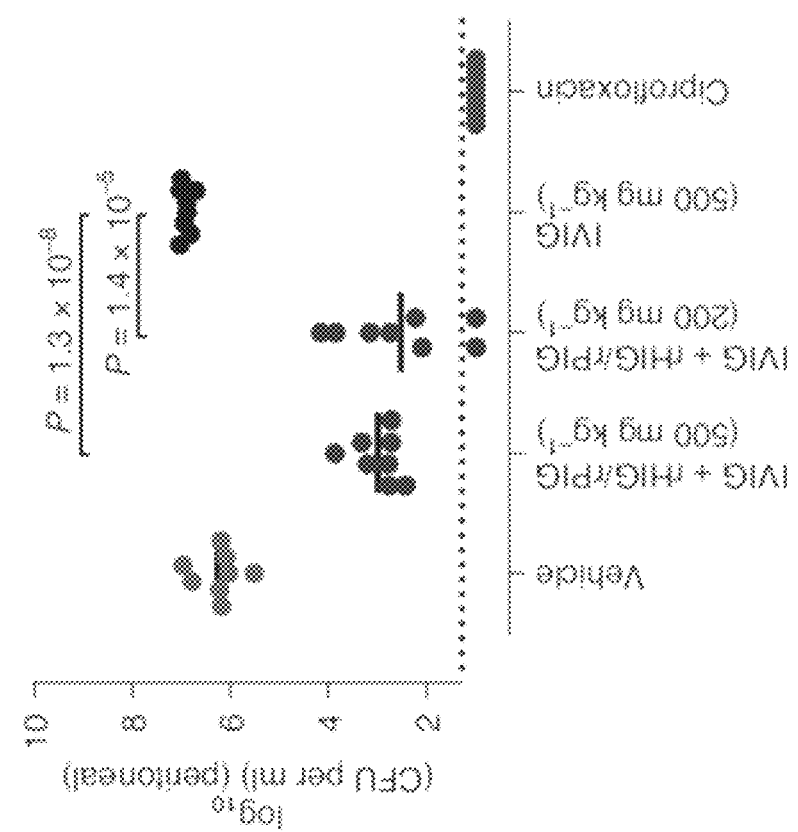
FIG. 10E

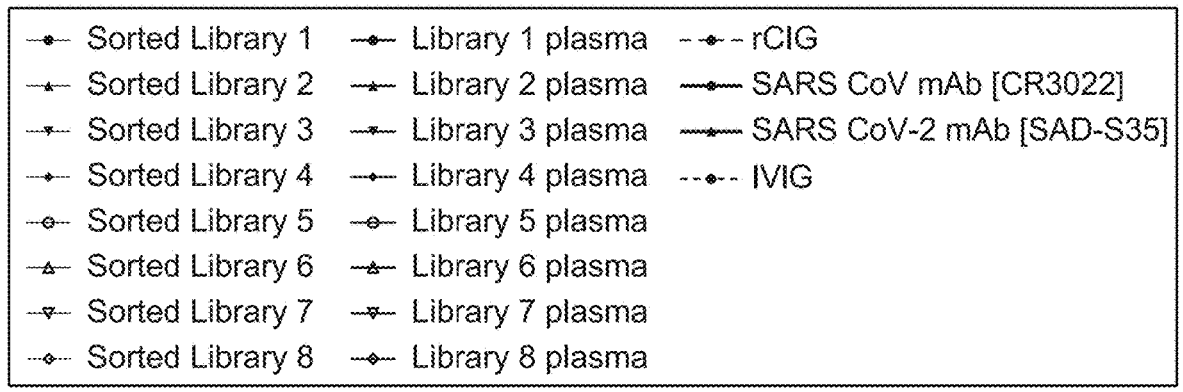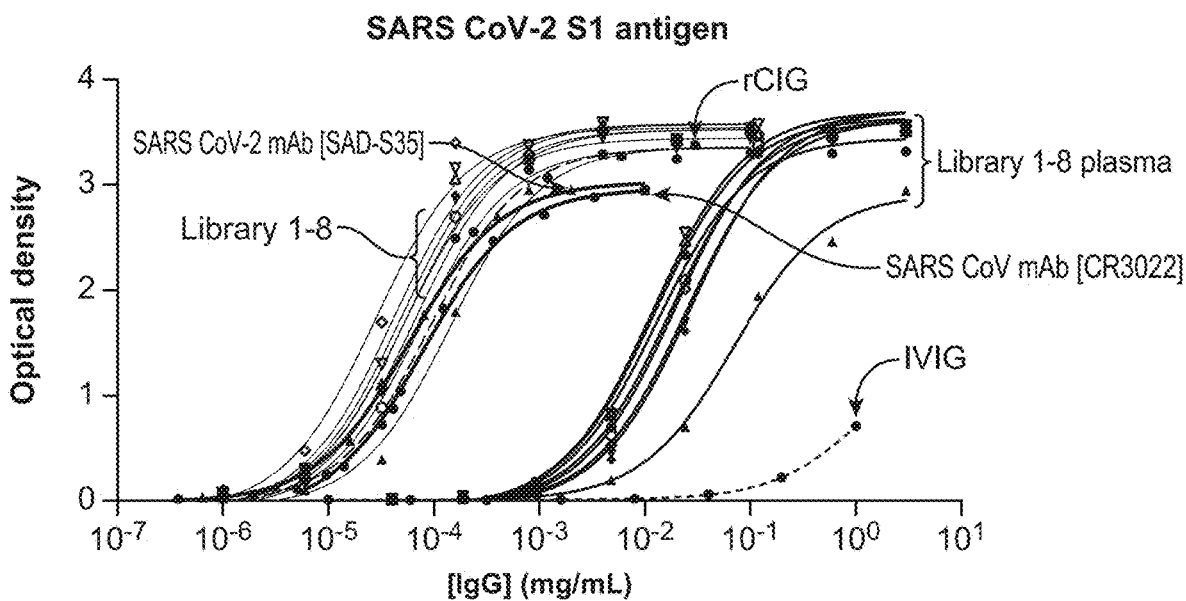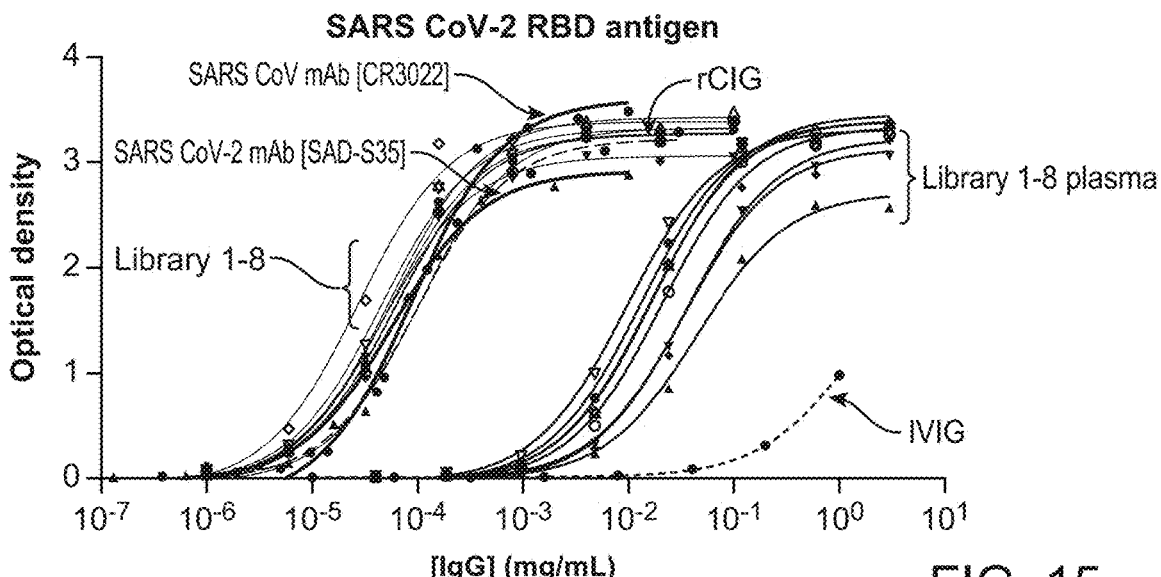
FIG. 15

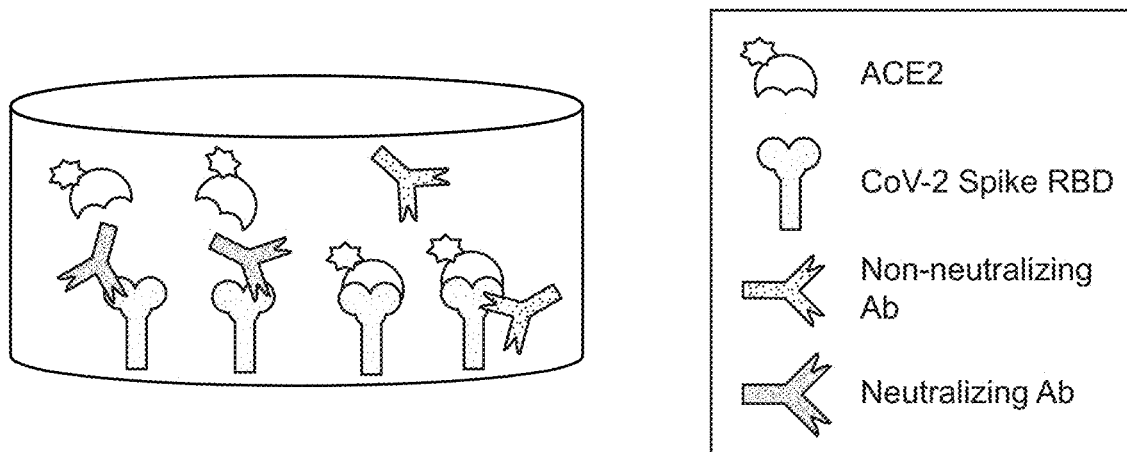
FIG. 16A
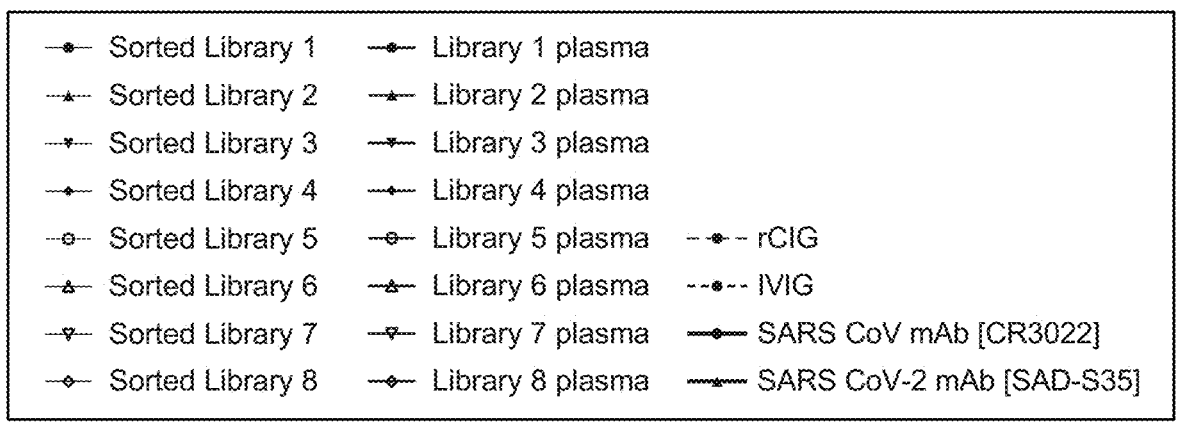
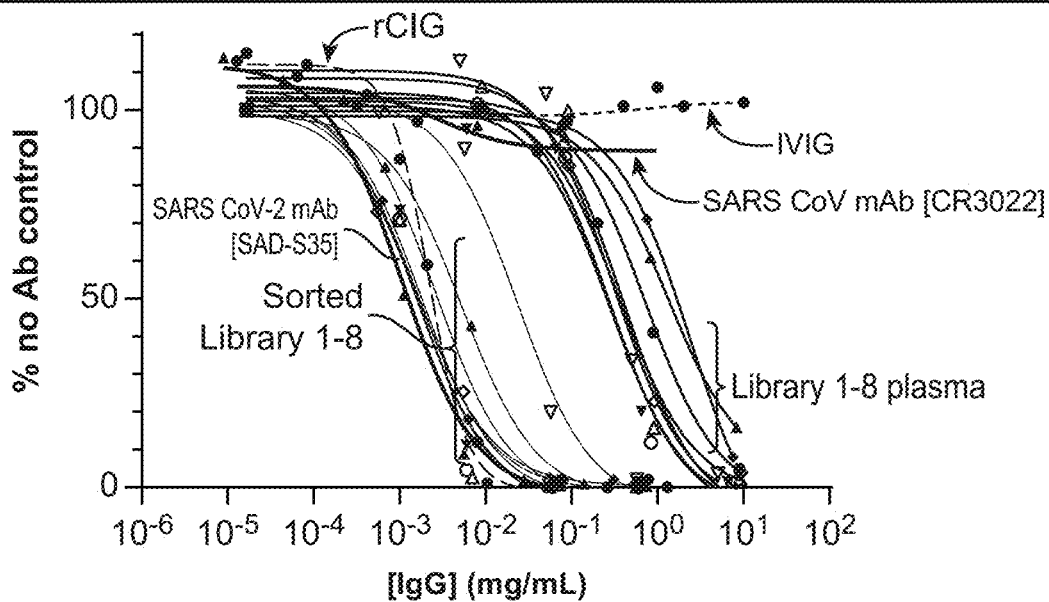
FIG. 16B

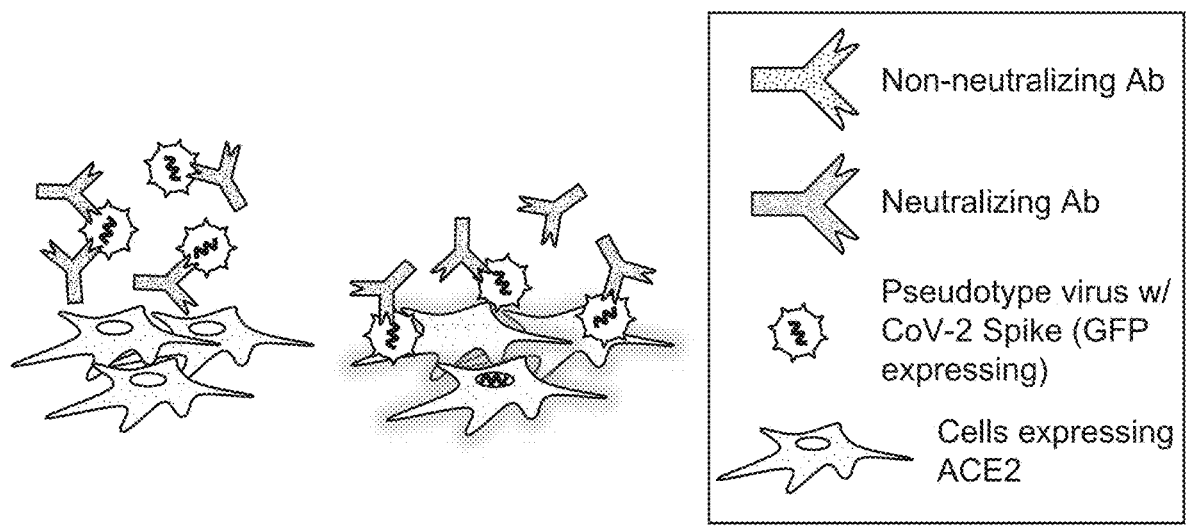
FIG. 17A
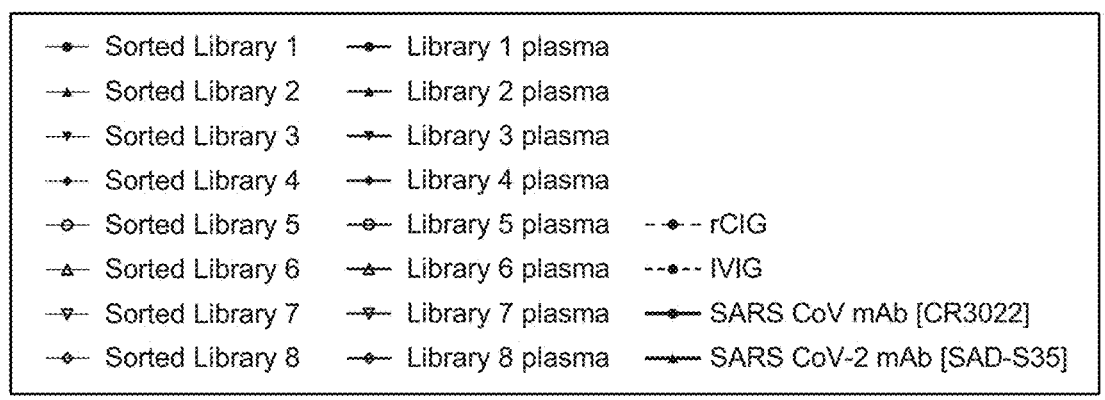
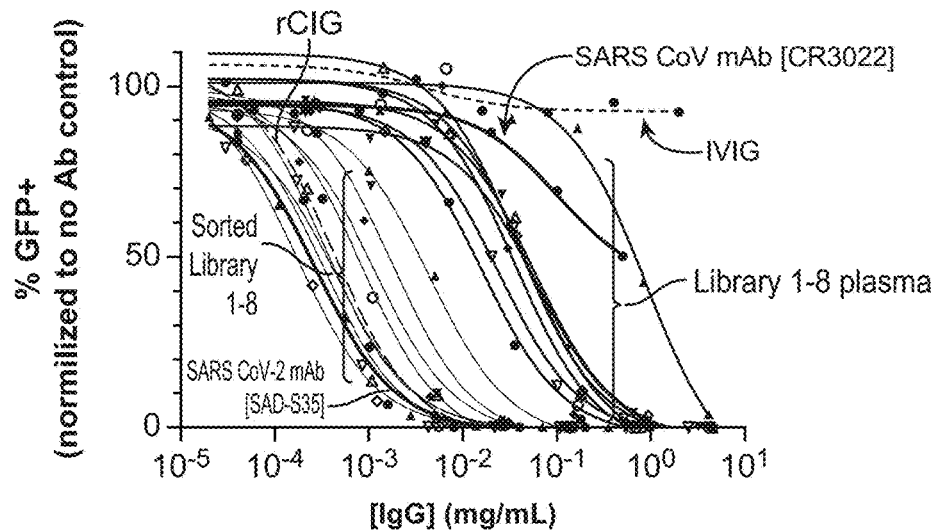
FIG. 17B

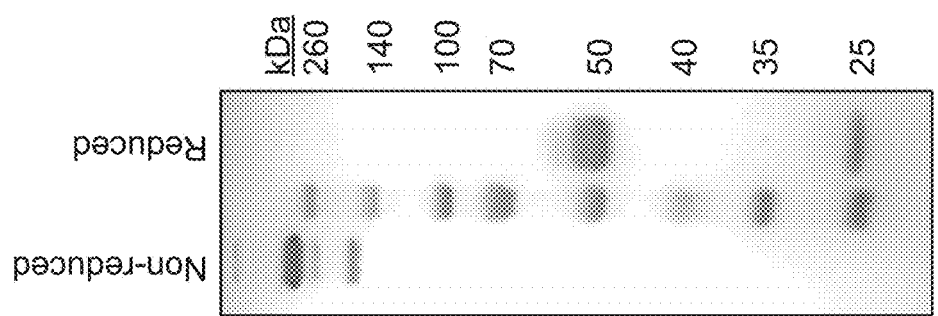
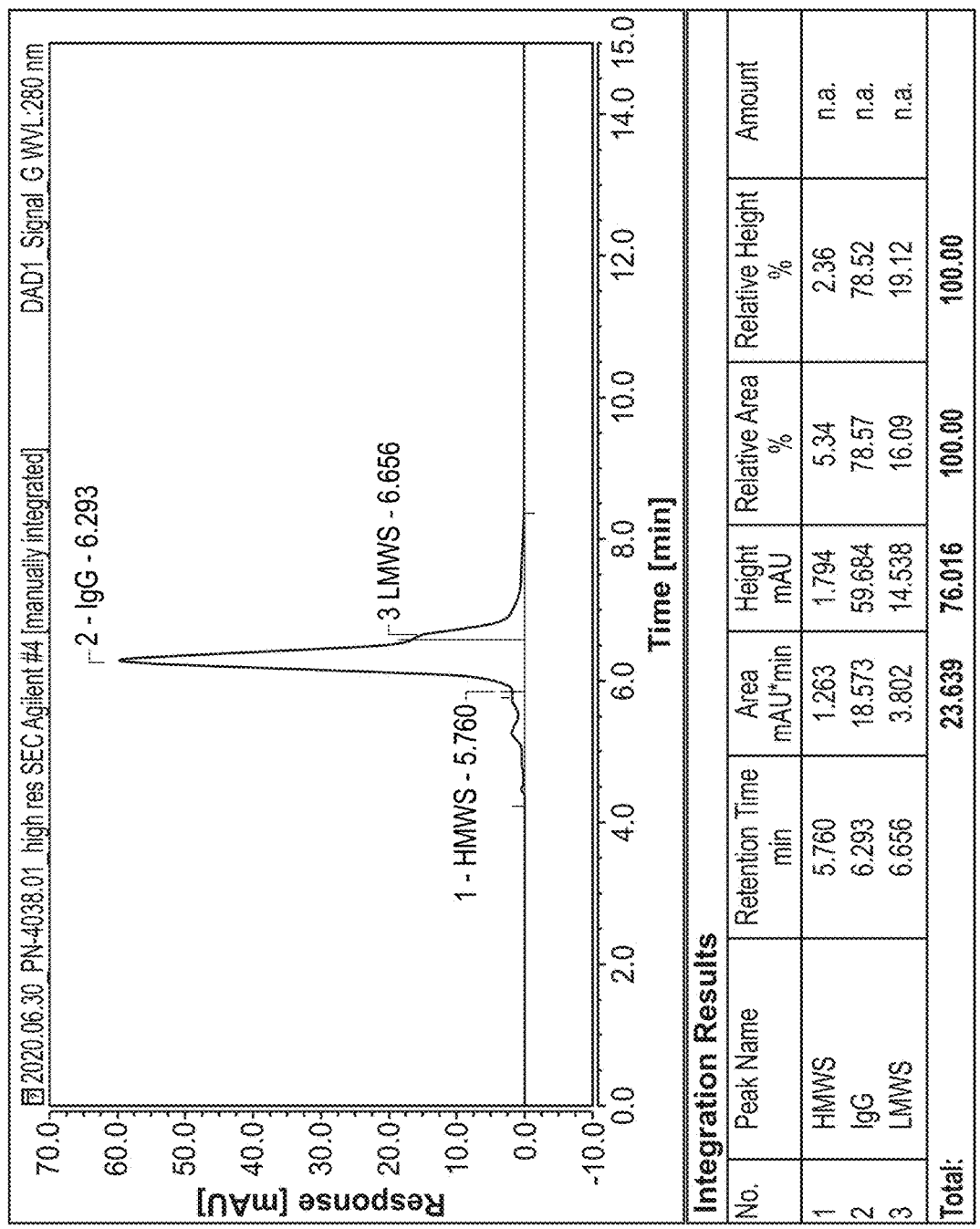
FIG. 18B
FIG. 18A

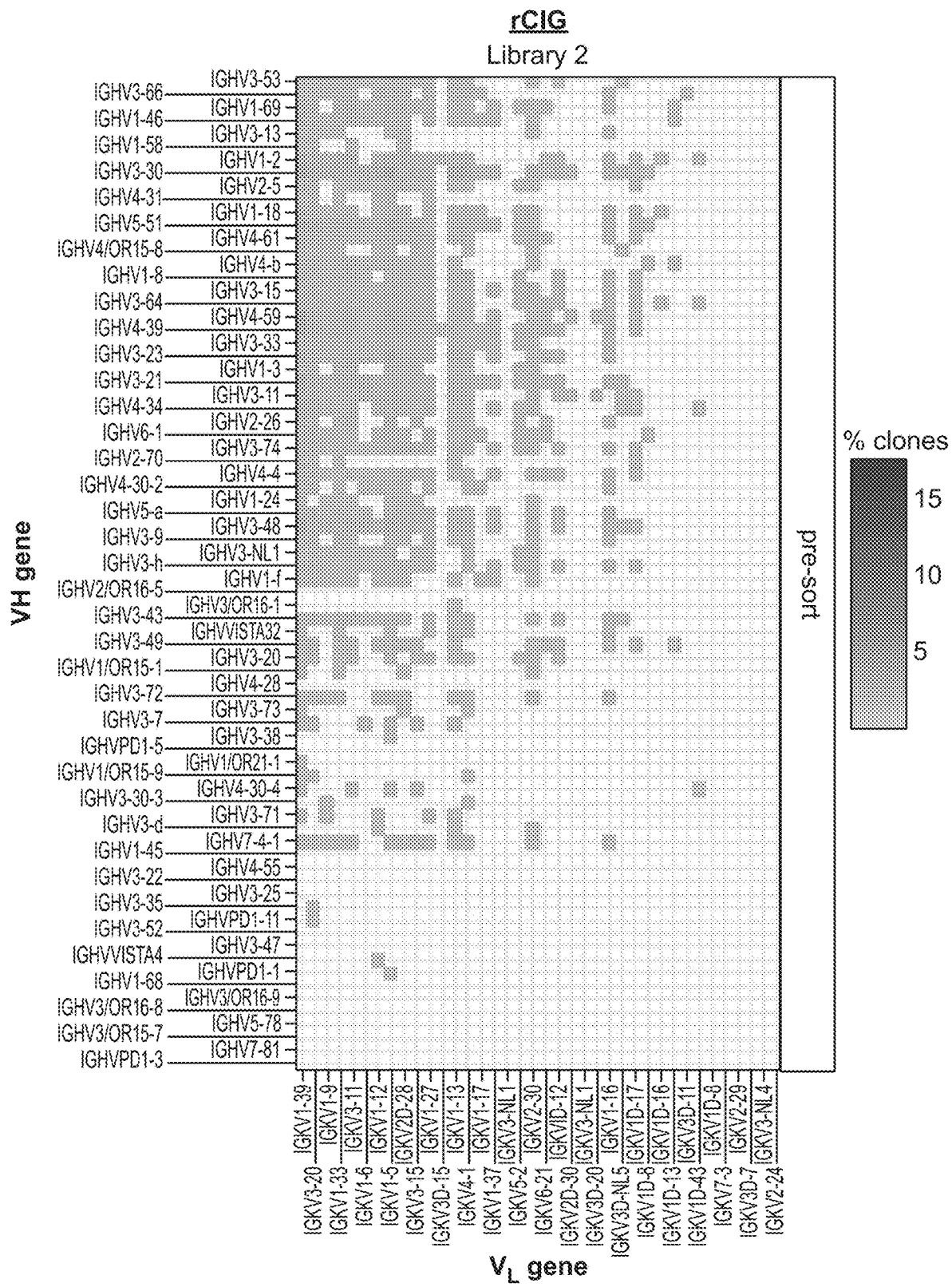
FIG. 21A (Cont. 1)

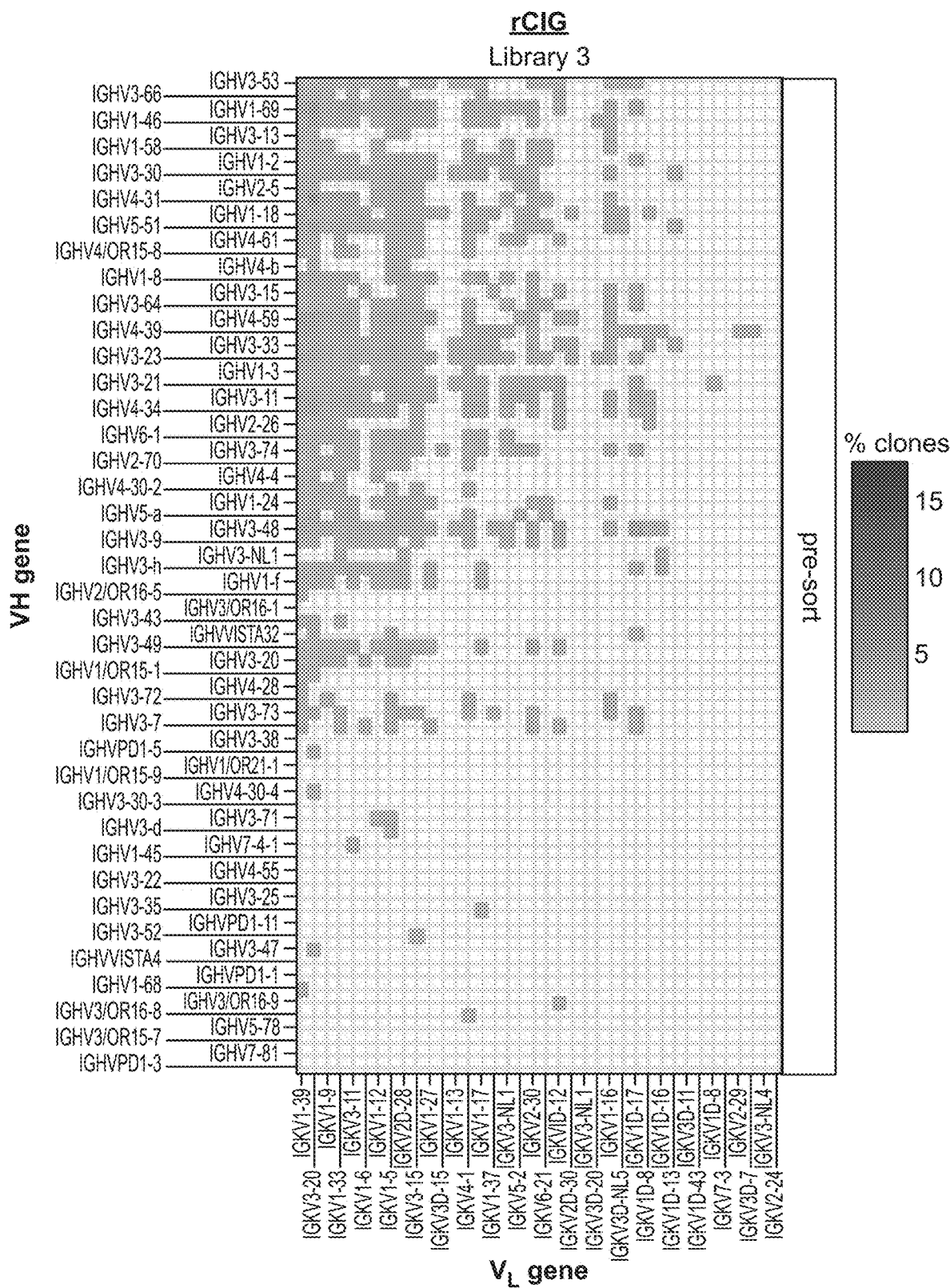
FIG. 21A (Cont. 2)

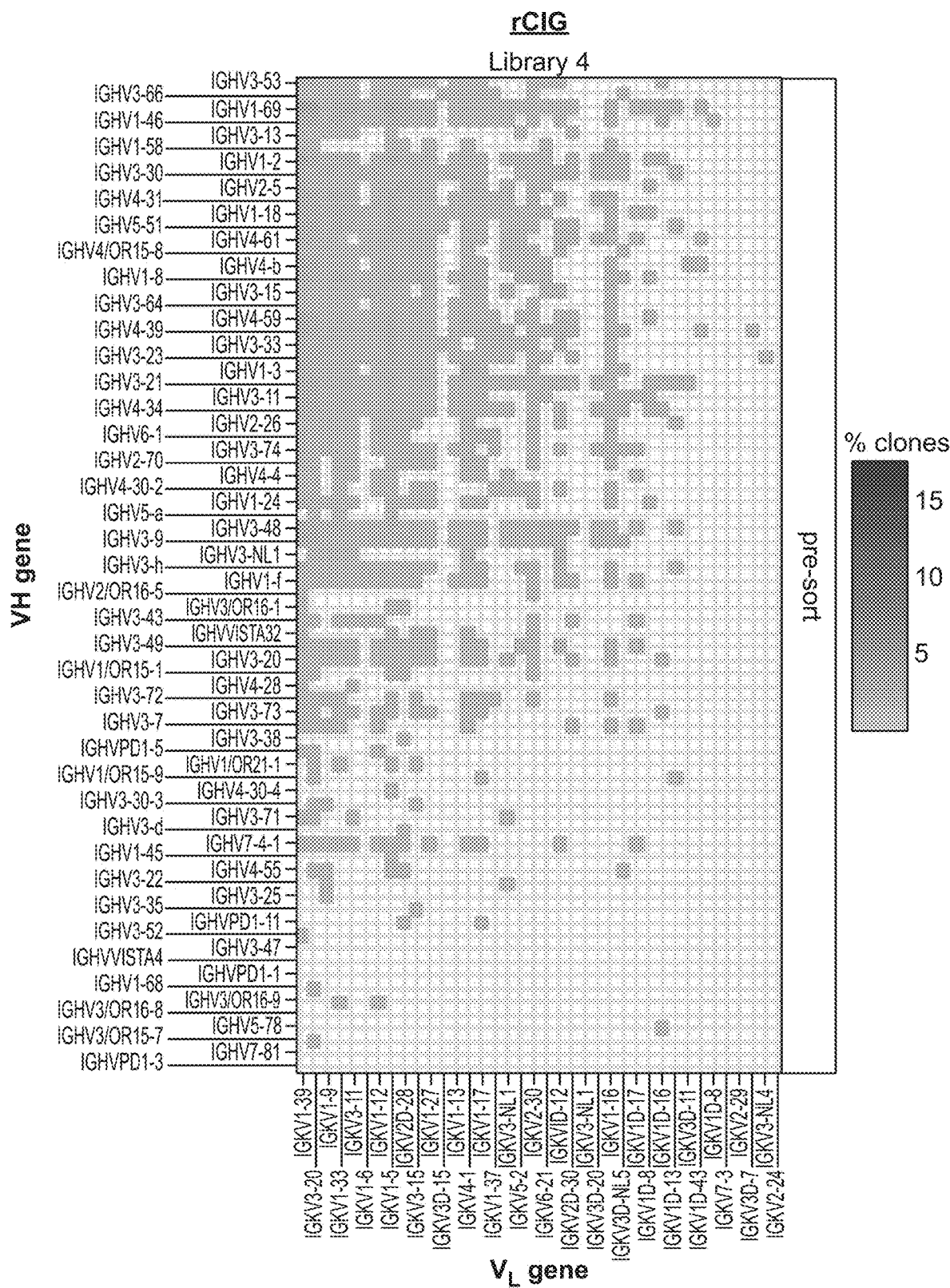
FIG. 21A (Cont. 3)

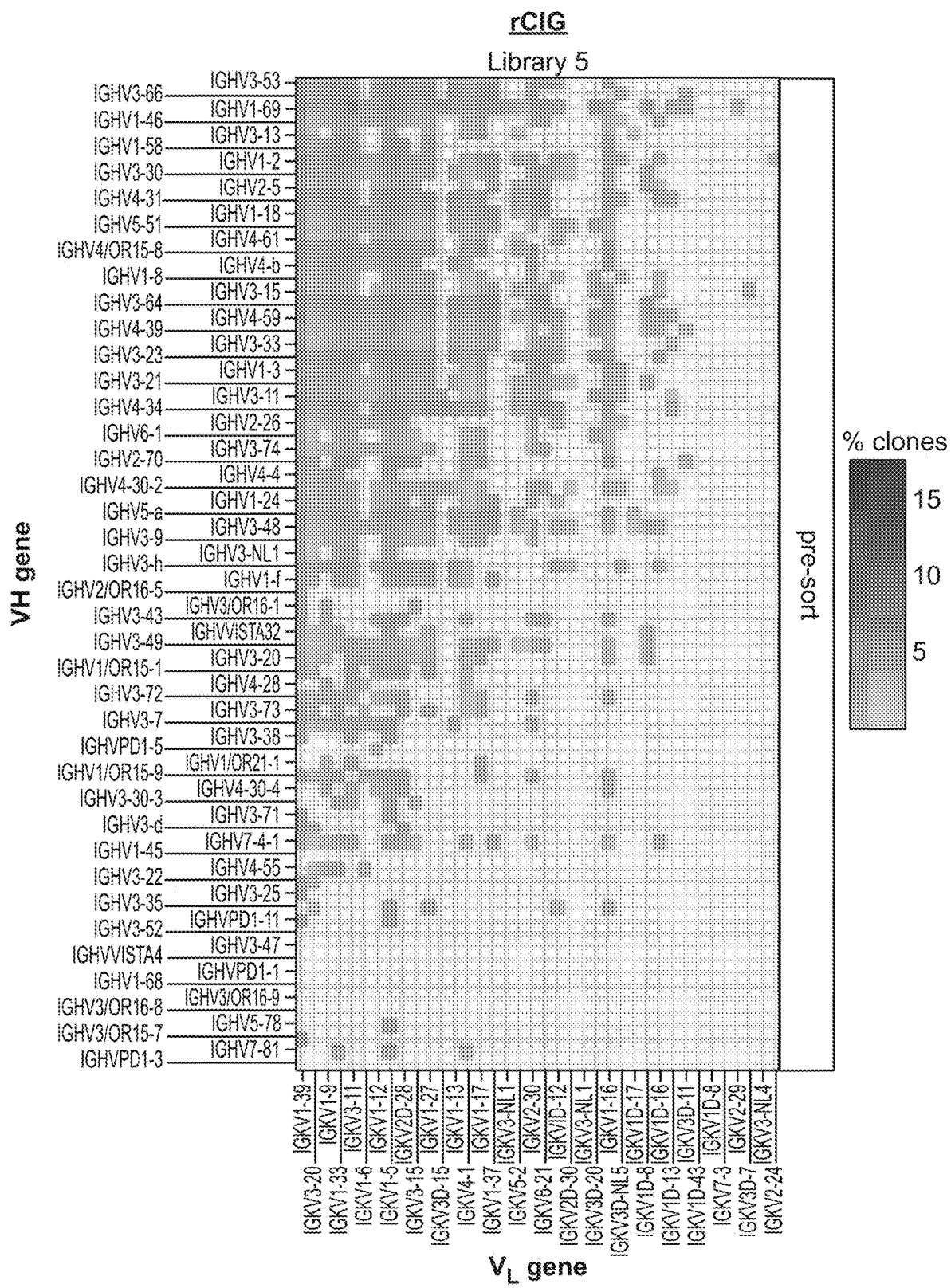
FIG. 21A (Cont. 4)

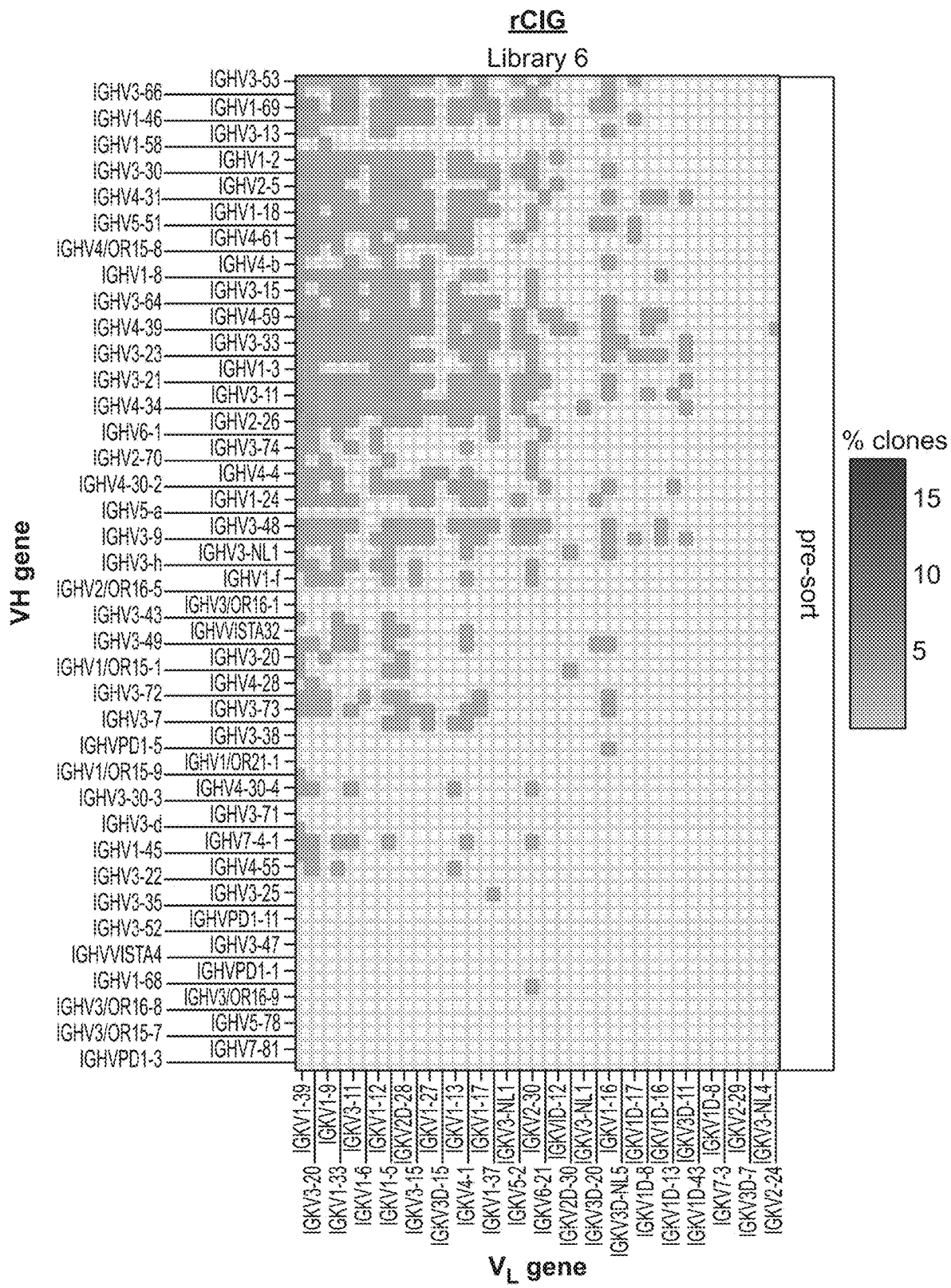
FIG. 21A (Cont. 5)

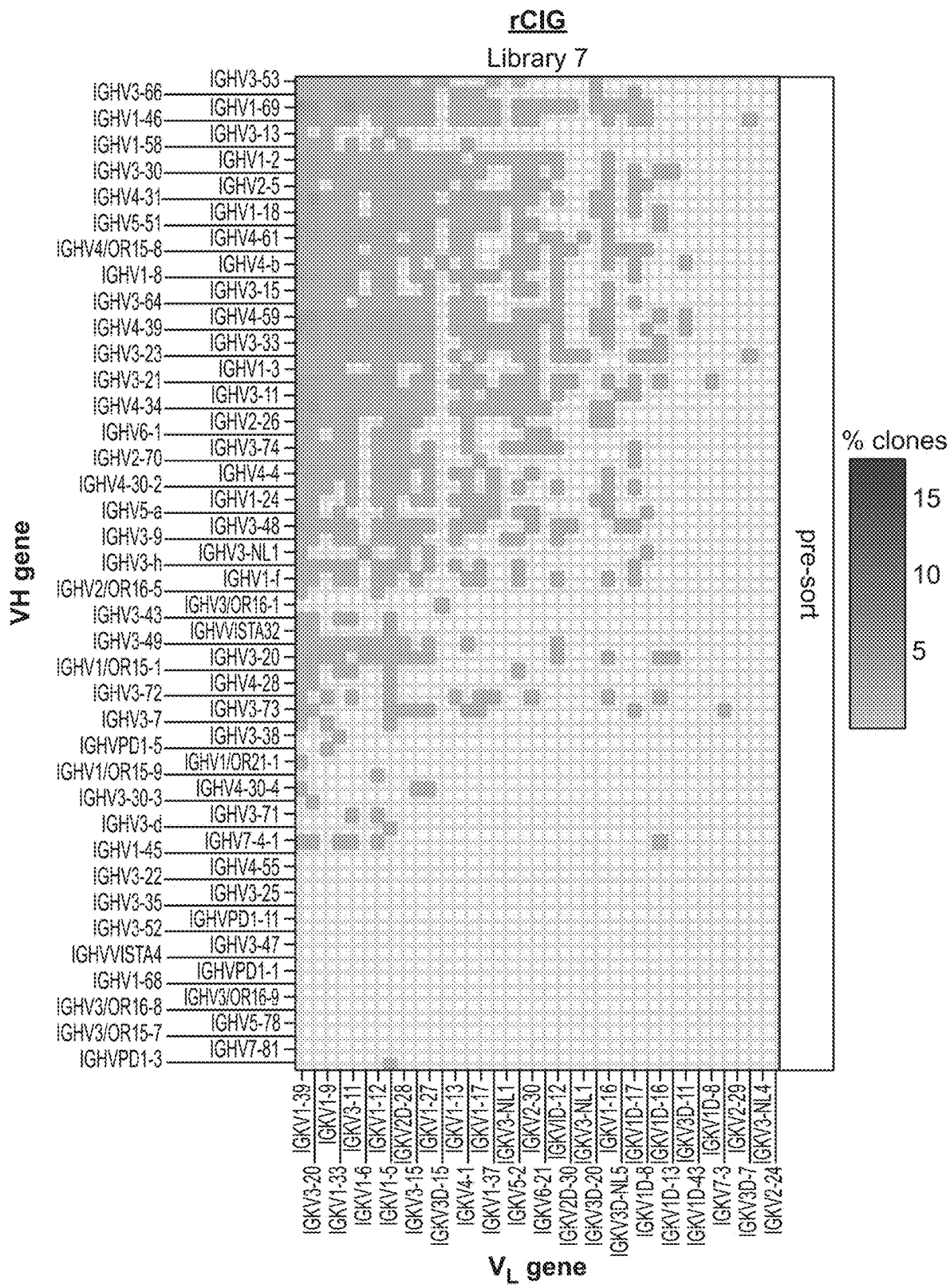
FIG. 21A (Cont. 6)

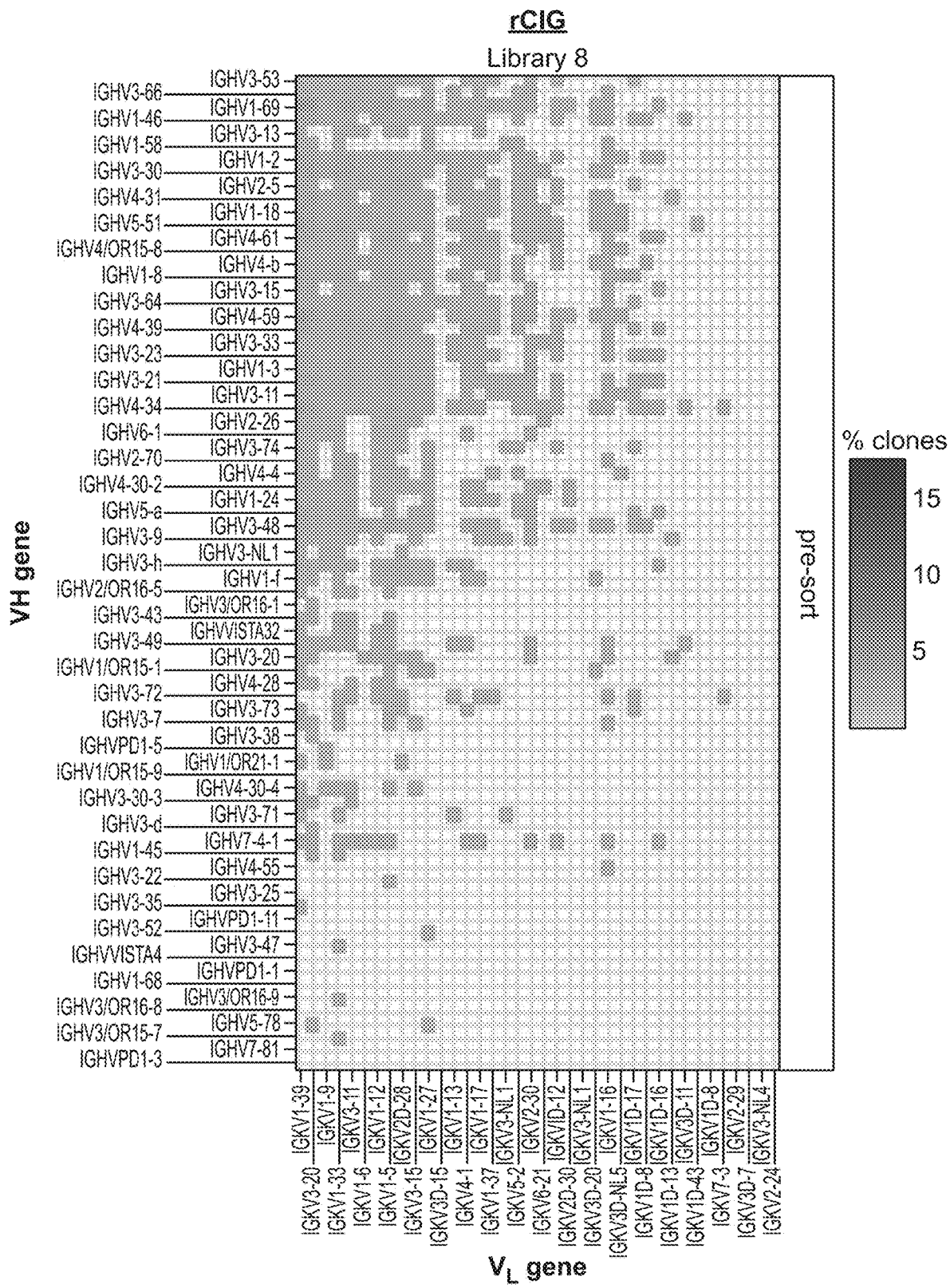
FIG. 21A (Cont. 7)

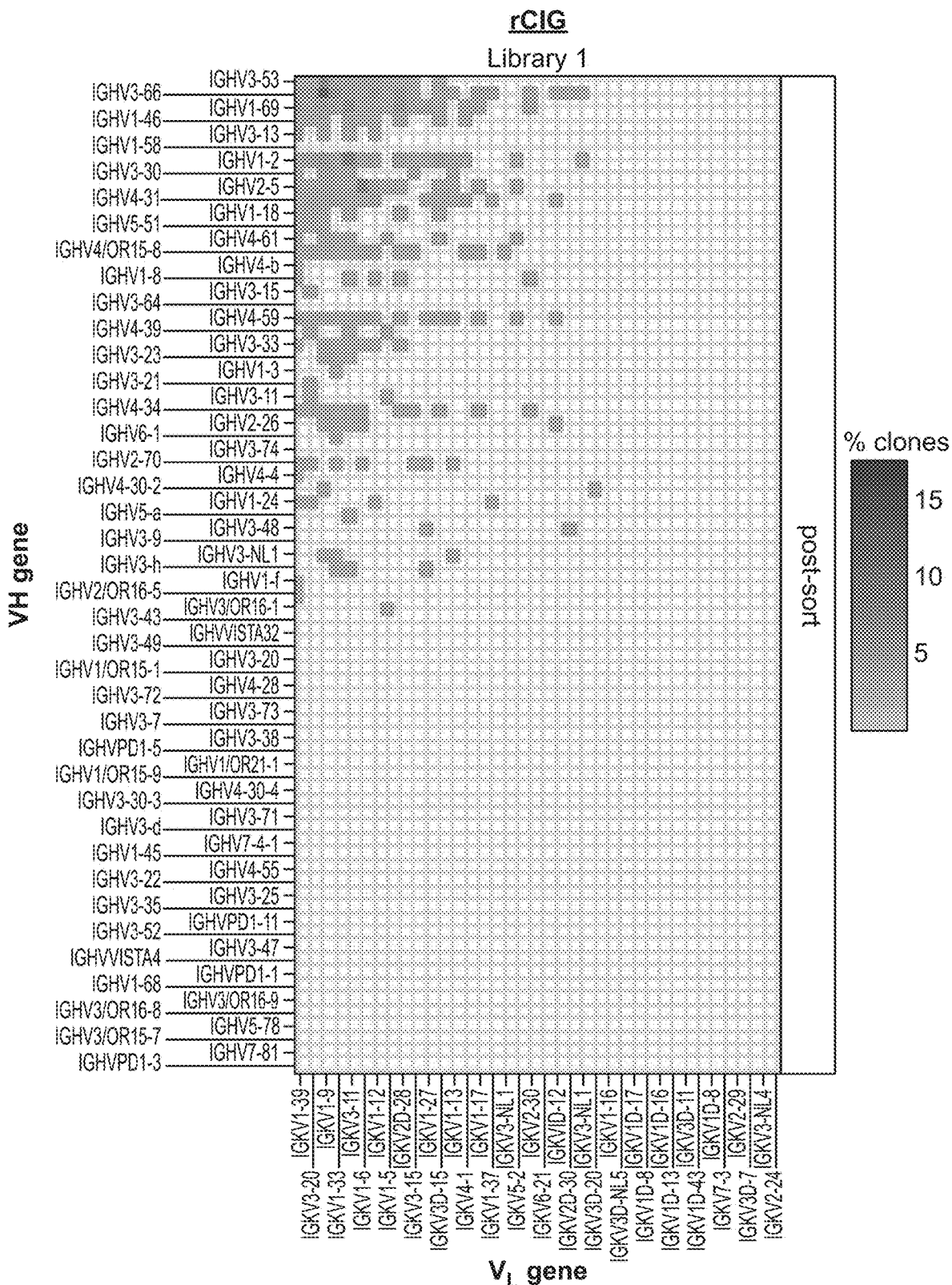
FIG. 21A (Cont. 8)

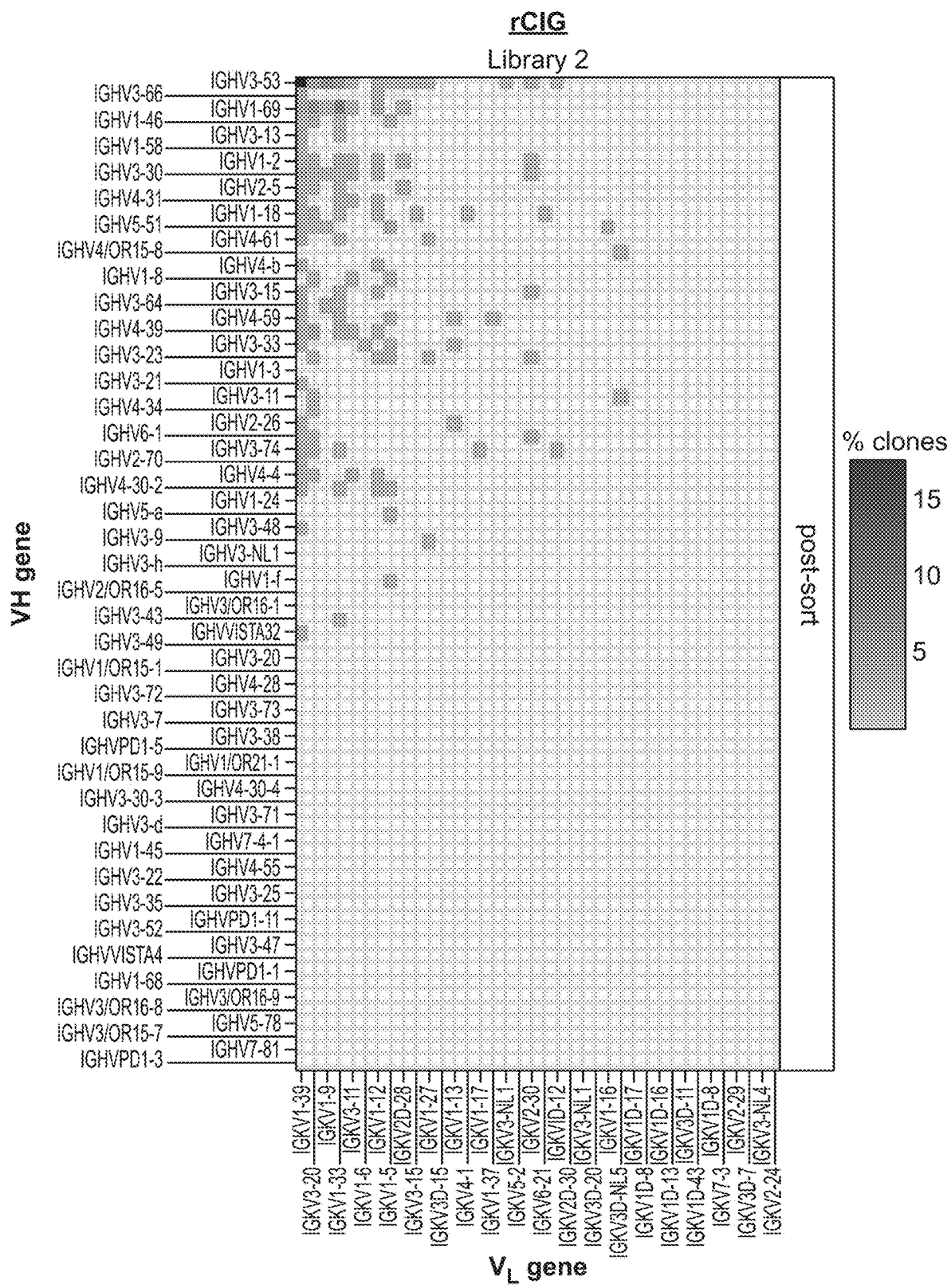
FIG. 21A (Cont. 9)

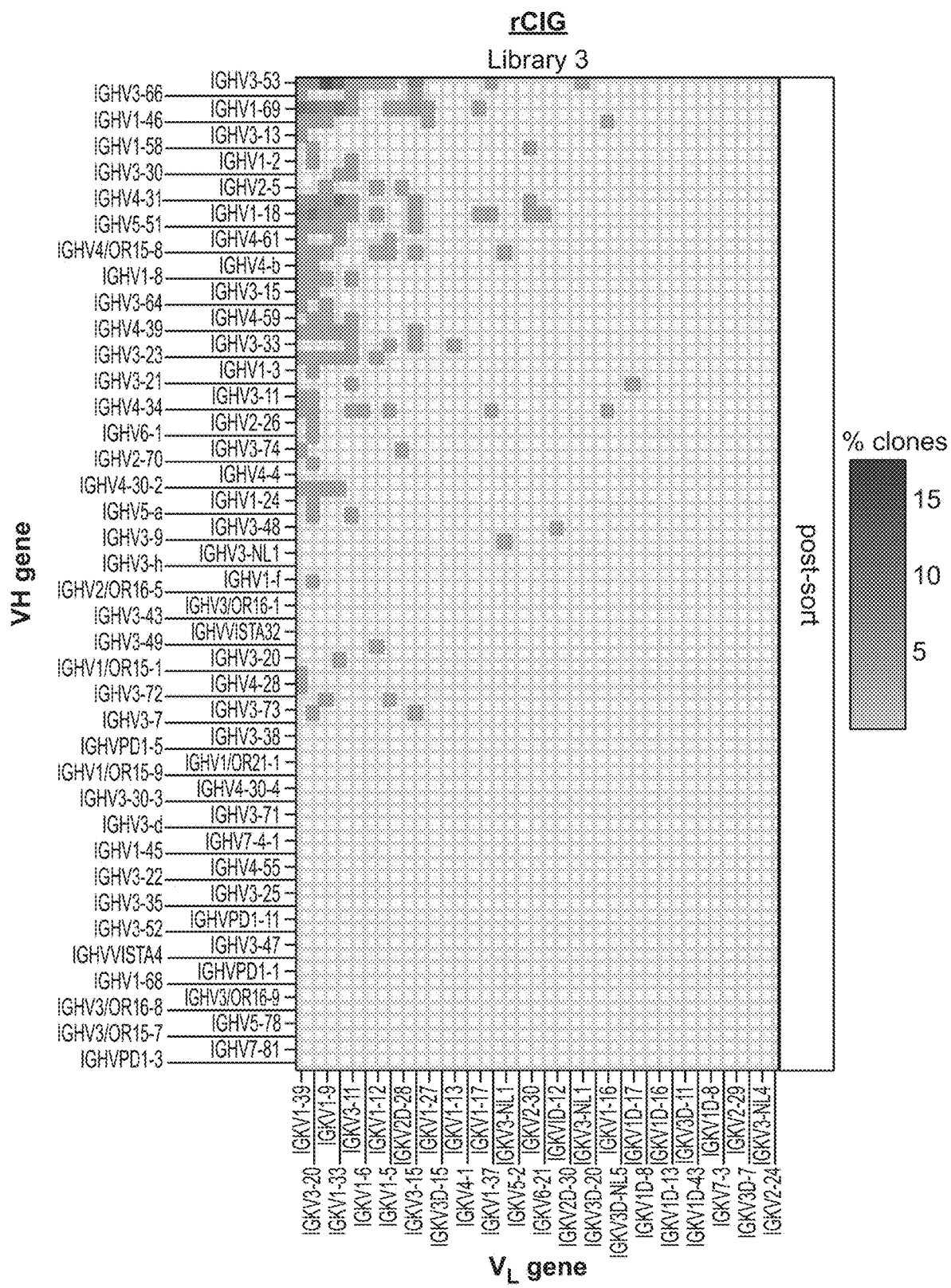
FIG. 21A (Cont. 10)

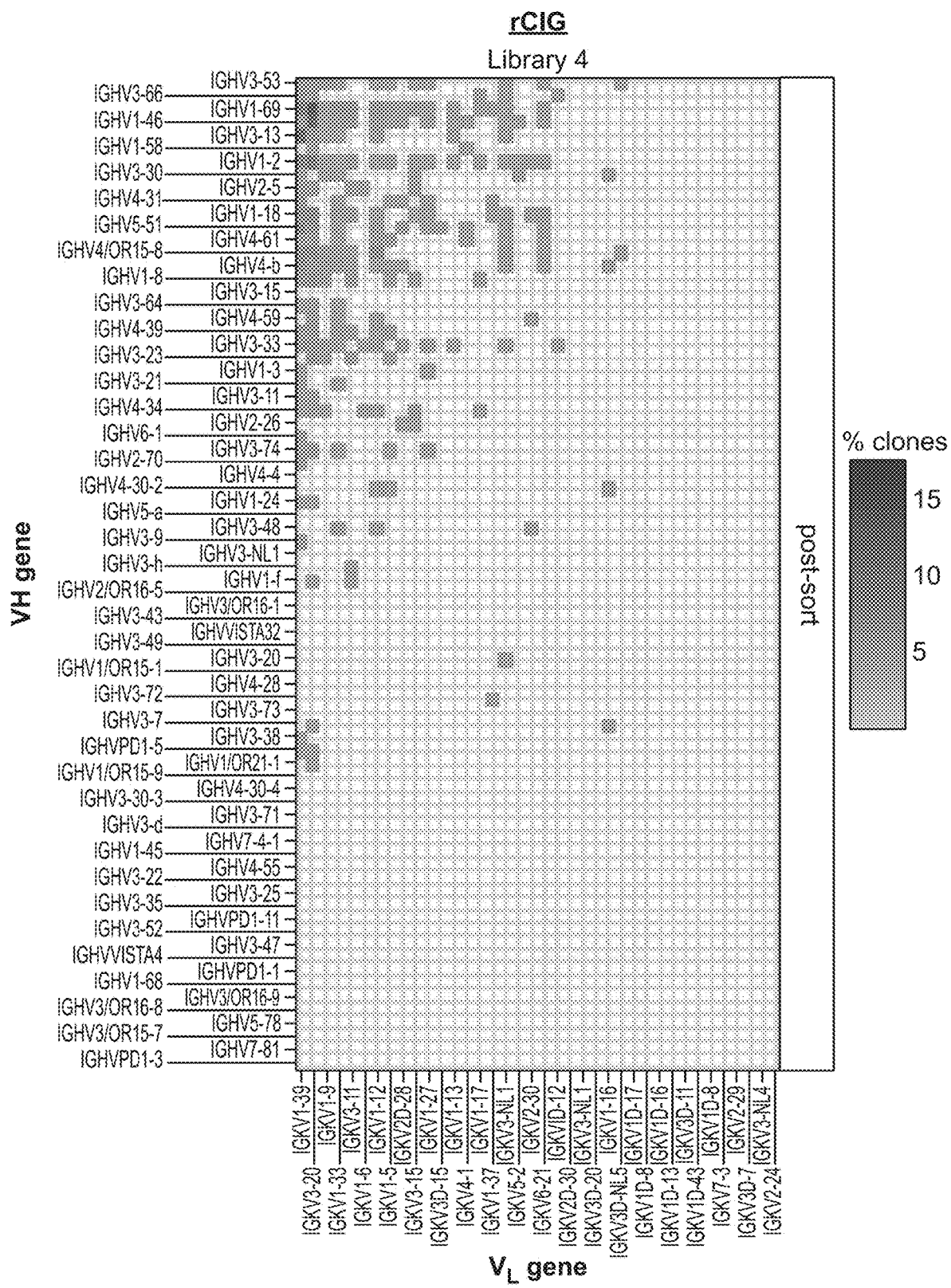
FIG. 21A (Cont. 11)

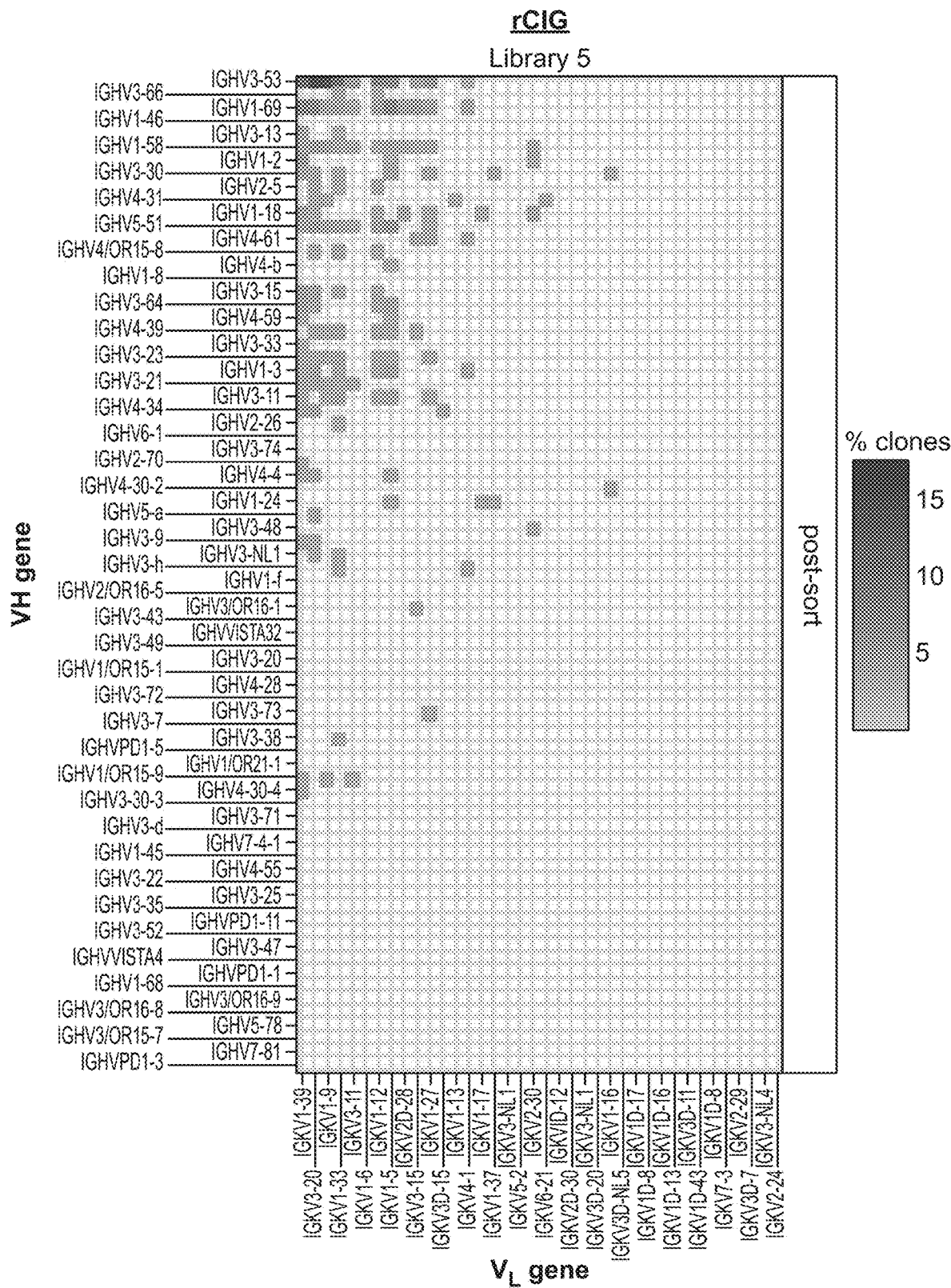
FIG. 21A (Cont. 12)

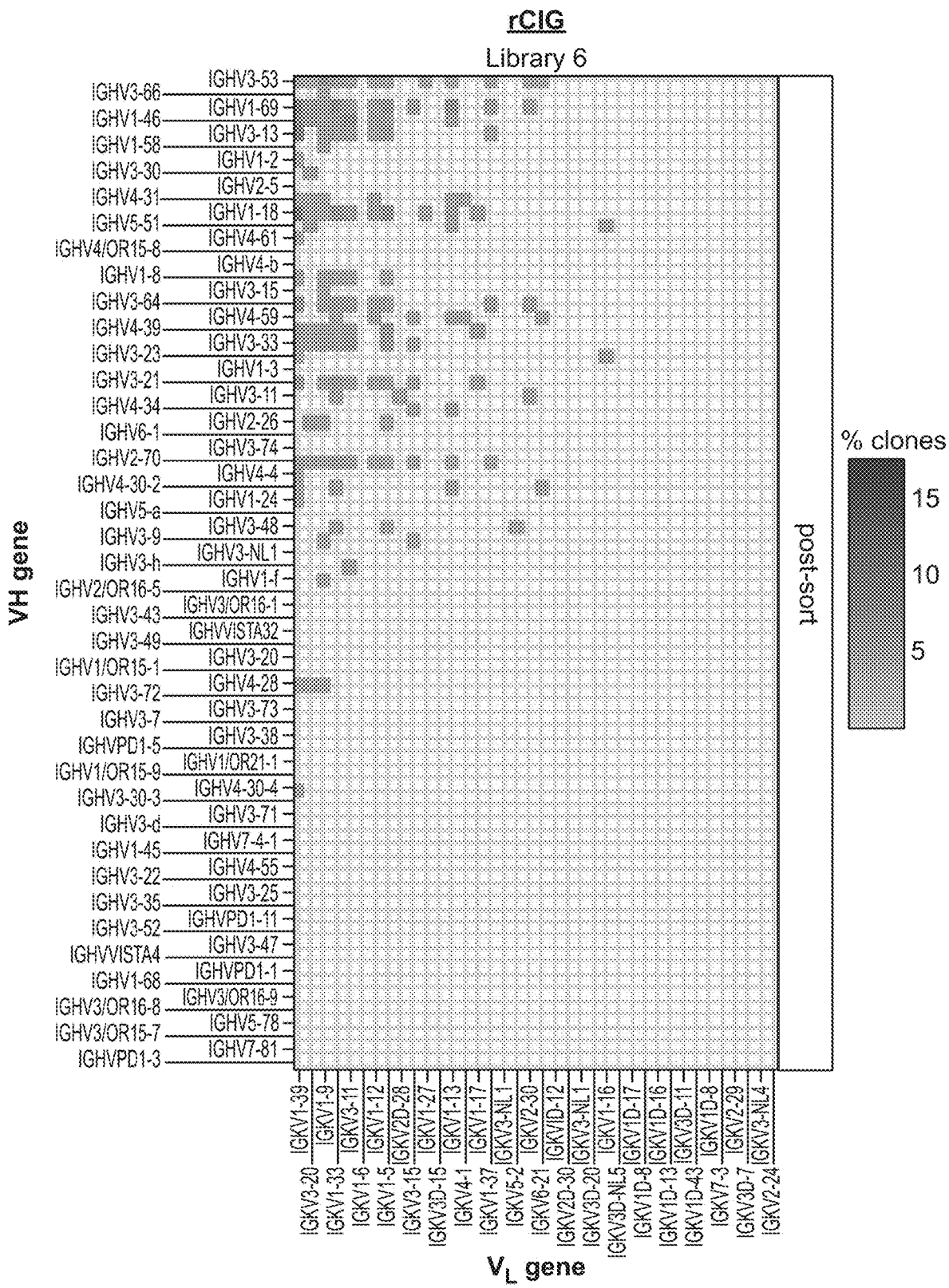
FIG. 21A (Cont. 13)

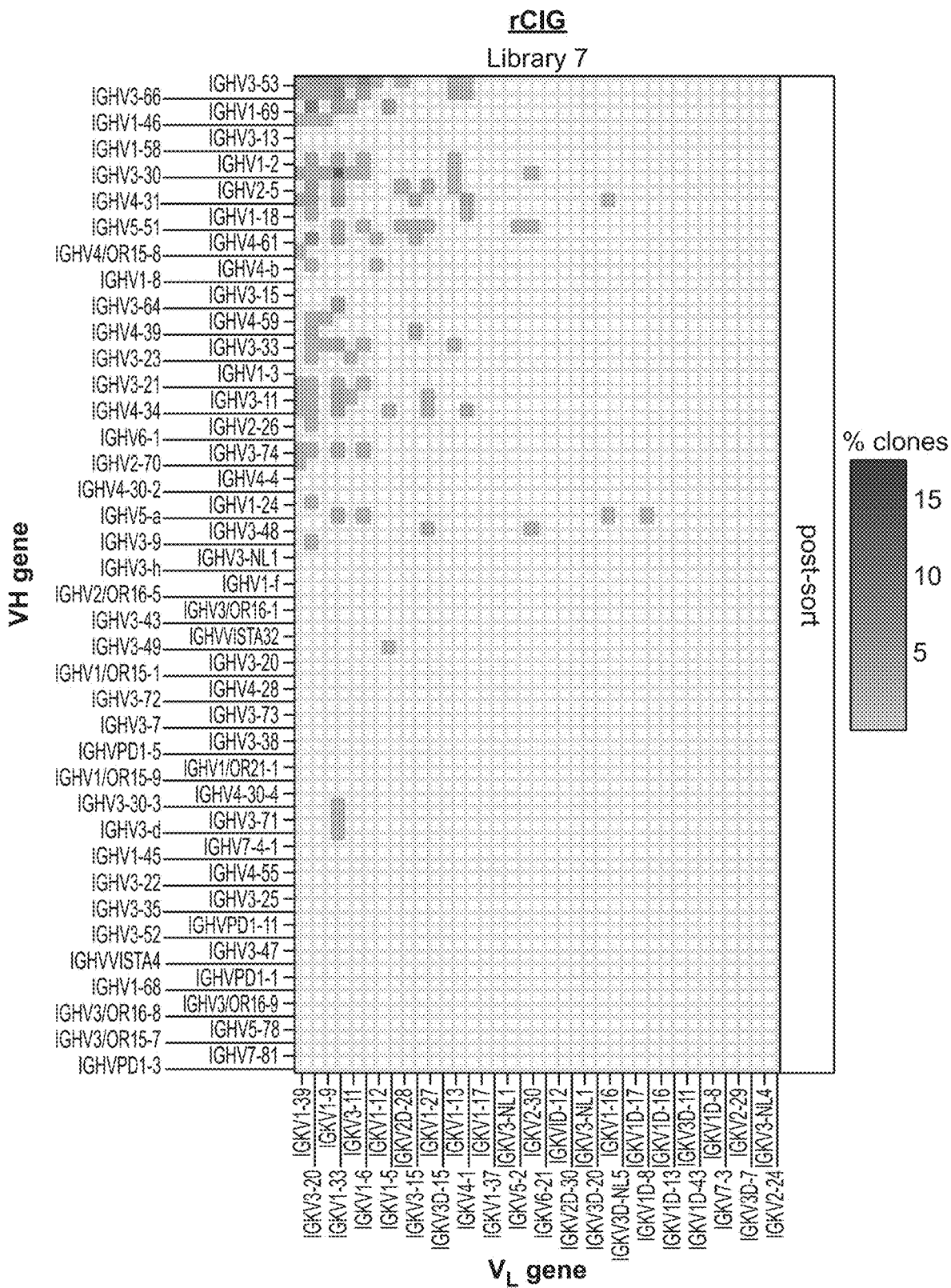
FIG. 21A (Cont. 14)

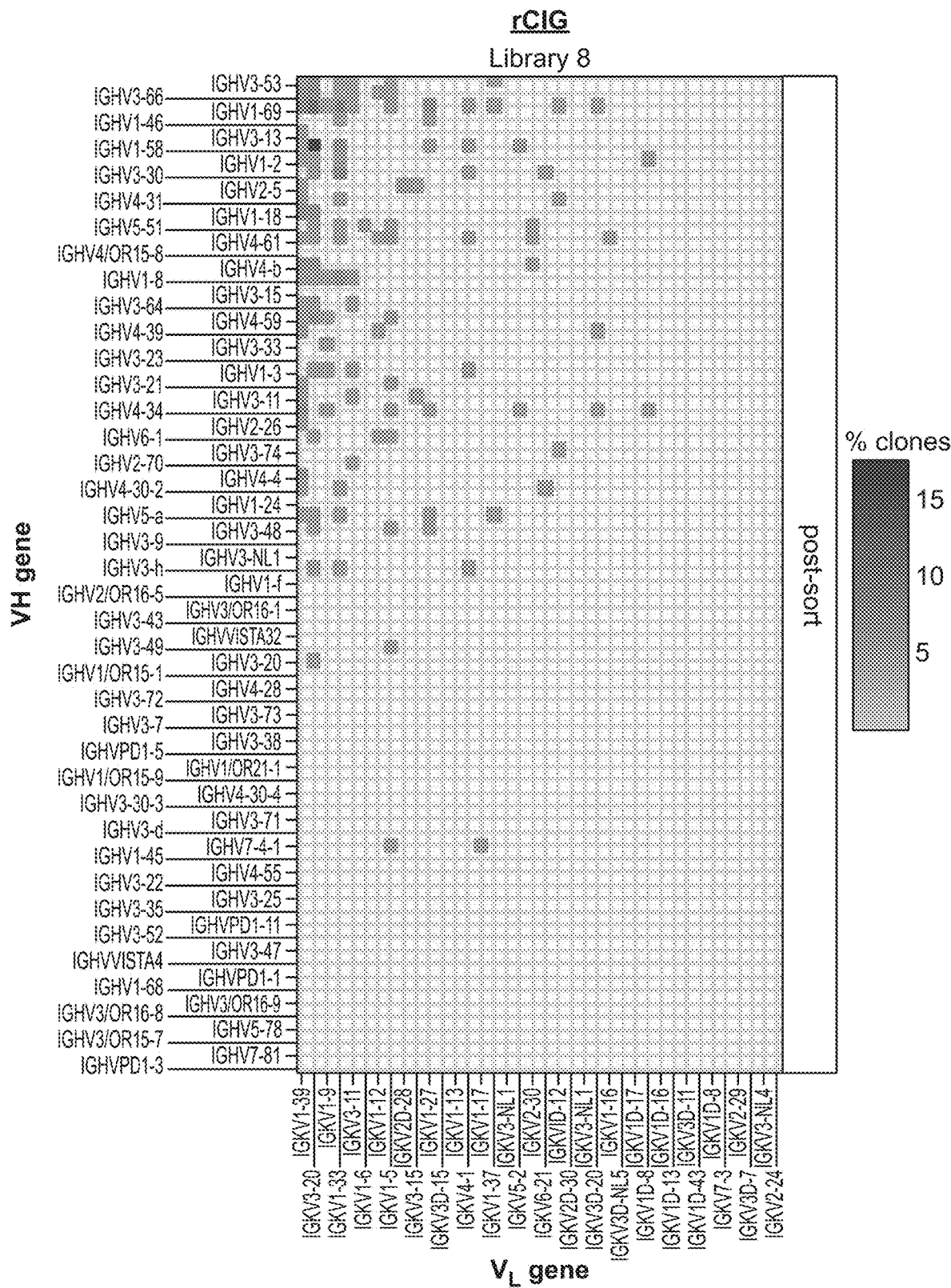
FIG. 21A (Cont. 15)

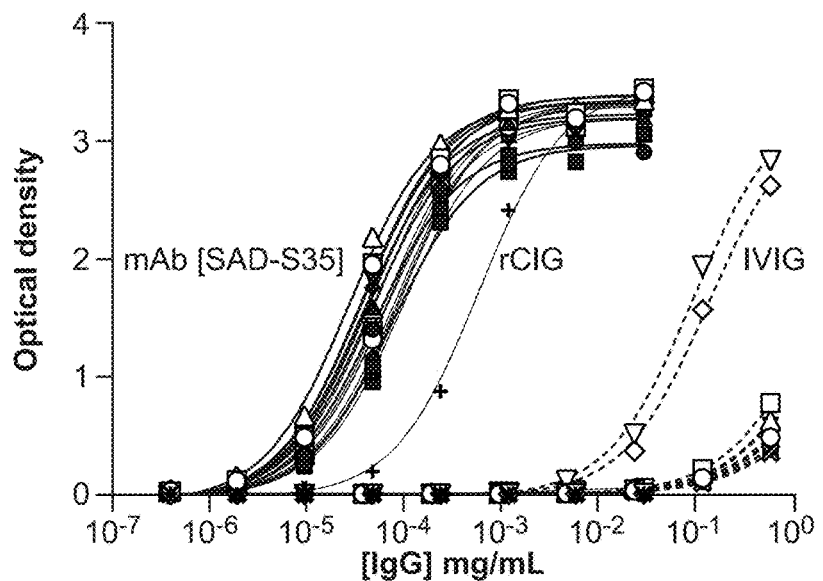
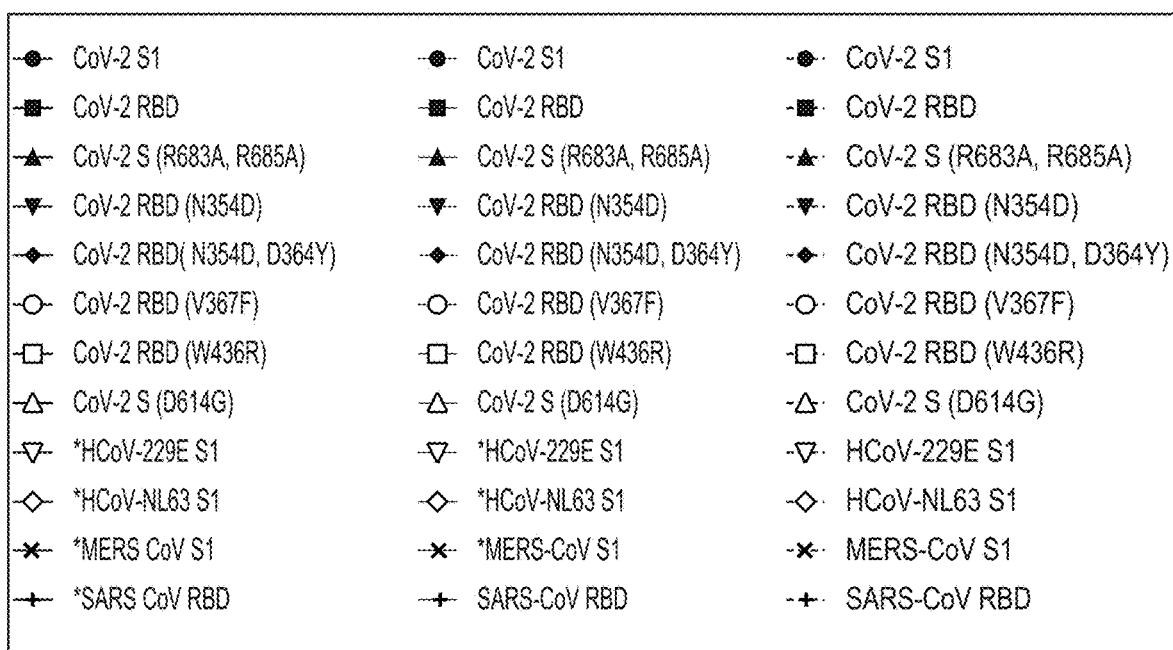
FIG. 22

FIG. 31

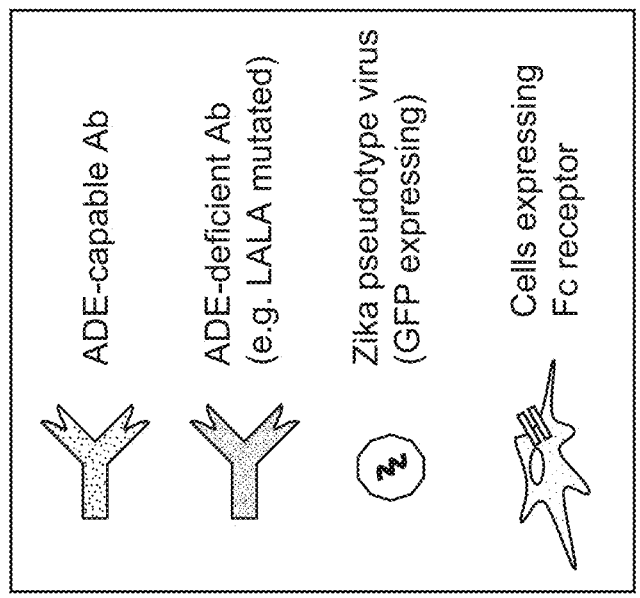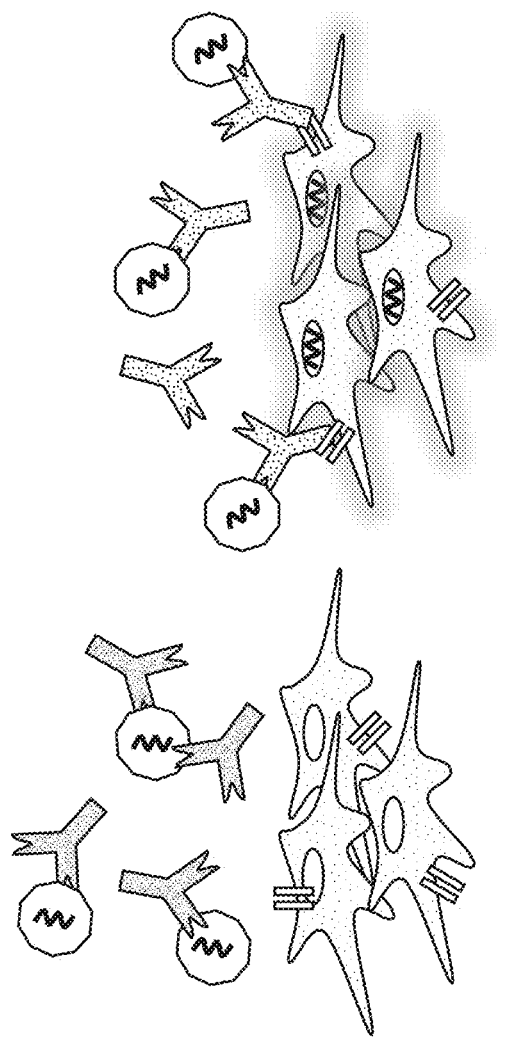
FIG. 32

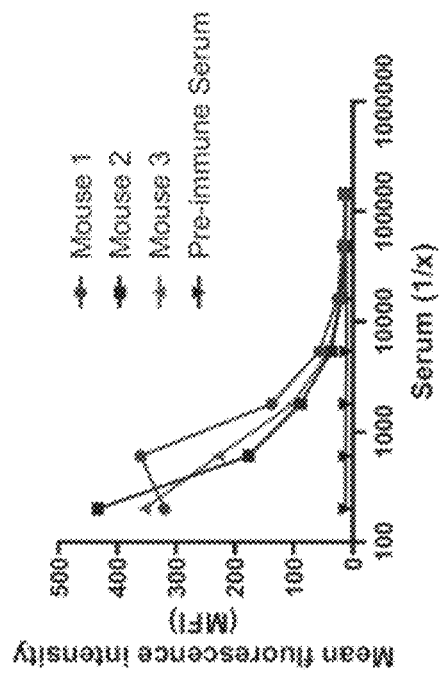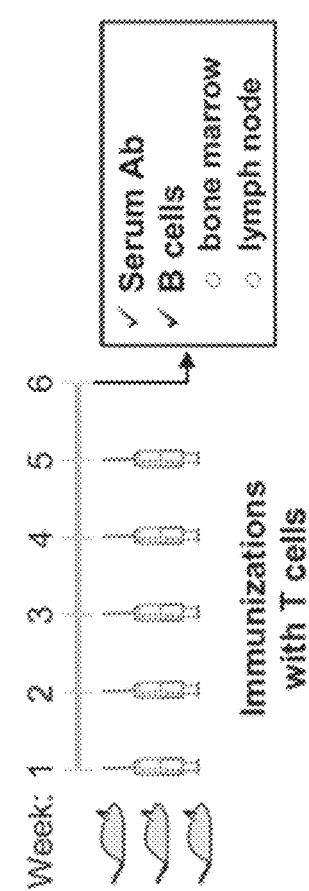
FIG. 43A

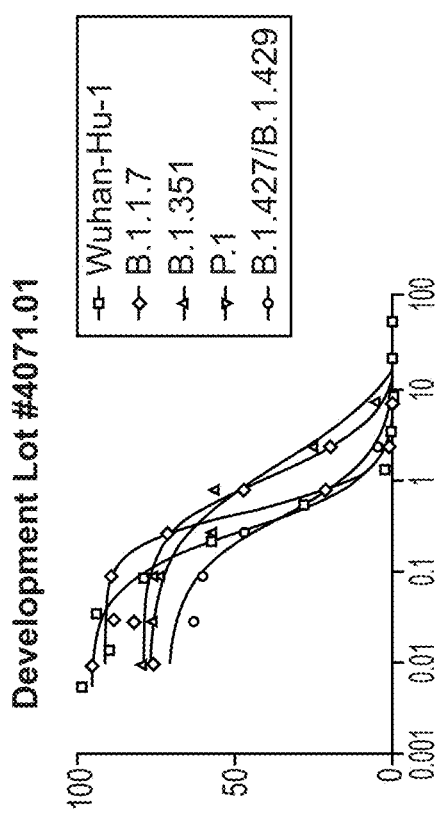
| Pseudotyped SARS-CoV-2 strain | $IC_{50}$ Value (μg/mL) |
|---|---|
| Wuhan-Hu-1 | 0.27 |
| B.1.1.7 (Uk) | 0.43 |
| B.1.351 (SA) | 1.5 |
| P.1 (J/B) | 1.0 |
| B.1.427/B.1.429 (CA) | 0.38 |
FIG. 51B

RECOMBINANT POLYCLONAL PROTEINS TARGETING COVID-19 AND METHODS OF USE THEREOF

1. CROSS REFERENCE TO RELATED APPLICATIONS

The present application is a continuation of International Application No. PCT/US21/37232, filed Jun. 14, 2021, which claims the benefit of U.S. Provisional Patent Application No. 63/038,470 filed on Jun. 12, 2020 and U.S. Provisional Patent Application No. 63/061,721 filed on Aug. 5, 2020 which are hereby incorporated by reference in their entirety.

2. SEQUENCE LISTING

The instant application contains a Sequence Listing with 8434 sequences which has been submitted via EFS-Web and is hereby incorporated by reference in its entirety. Said ASCII copy, created on May 26, 2022, is named 49318US_CRF_sequencelisting.txt, and is 1,896,000 bytes in size.

3. FIELD

Provided herein are recombinant polyclonal proteins (RPPs), also called recombinant polyclonal antibody proteins, recombinant hyperimmune globulins, or simply recombinant hyperimmunes, with binding specificity for SARS CoV-2 antigens, i.e., rCIG (recombinant anti-coronavirus 19 hyperimmune gammaglobulin). Included are therapeutics, vaccines, and libraries, and compositions comprising such RPPs, including pharmaceutical compositions. Also provided are methods of making RPPs, and methods of using RPPs, for example, for therapeutic purposes.

4. BACKGROUND

Many diseases, such as those caused by infectious viruses or bacteria with many variants or serotypes, are best treated by drugs that target multiple epitopes. An established therapeutic modality is multispecific (multivalent) antibodies derived from human or animal plasma, such as intravenous immunoglobulin (IVIG). Polyclonal antibody drugs with higher potency, known as hyperimmune globulins, are often derived from the plasma of recently vaccinated human donors, for example, HepaGam B against hepatitis B virus (HBV) and BabyBIG against infant botulism. In diseases for which human vaccination is not possible, hyperimmune globulins can be generated by immunizing animals, for example, rabbit-derived thymoglobulin ('rabbit-ATG') against human thymocytes for transplant tolerance. For rapid response to emerging pathogens with poorly characterized neutralizing epitopes, many groups have developed hyperimmune globulins derived from immunized animal plasma or convalescent human serum, for example, Zika virus hyperimmune globulin or severe acute respiratory syndrome coronavirus-2 (SARS-CoV-2).

Plasma-derived antibody therapeutics have substantial drawbacks. First, demand for normal and convalescent donor plasma often outstrips supply. Plasma-derived drugs have suffered from impurities, including infectious viruses and clotting factors, that have resulted in serious adverse events. Antibody drugs derived from animal plasma occasionally cause allergic reactions, lead to antidrug antibodies and have suboptimal effector properties. Because they are derived from naturally occurring proteins, plasma-derived drugs are not easily engineered; for example, it is not possible to modify Fc sequences to improve mechanism of action or drug half-life. Finally, each batch of plasma-derived drug is usually derived from a different cohort of human donors or animals, resulting in batch-to-batch variation.

Many of these problems could be solved by generating multivalent hyperimmune globulins using recombinant DNA technology. However, this strategy presents substantial technical hurdles. Most important, a recombinant hyperimmune globulin technology would have to isolate significant numbers of B cells from donors or animals, natively pair heavy and light chain immunoglobulin at a single-cell level, and then clone the sequences into recombinant expression libraries for manufacturing. Conventionally, most production cell lines for recombinant antibody drugs are generated by random integration of expression constructs into mammalian cell genomes. To prevent mispairing between heavy and light chain immunoglobulin, a recombinant polyclonal hyperimmune globulin technology would require a single genome-integration site. Pioneering work used 96-well plates to capture antibody sequences from B cells isolated from human donors immunized with Rho(D)$^+$ erythrocytes and then engineer multivalent recombinant antibodies, but this approach produced drug candidates with <30 antibodies, complicating broad application and reducing potential for polyvalence.

5. SUMMARY

Provided herein are rCIG (recombinant anti-coronavirus 19 hyperimmune gammaglobulin), i.e., novel RPP (recombinant polyclonal proteins, also called recombinant polyclonal antibody proteins, recombinant hyperimmune globulins, or recombinant hyperimmunes) with binding specificity for a SARS-CoV-2 antigen, and methods of using such RPP, e.g., as human therapeutics. The RPP is recombinant, and its sequences are derived from peripheral blood B cells, plasma cells, or plasmablasts. The peripheral blood plasma cells or plasmablasts are mobilized by, e.g., infection of a donor with SARS-CoV-2, and the peripheral blood plasma cells or plasmablasts are specifically separated from other peripheral blood cells. The peripheral blood cells can come from any mammal, for example a mouse, a rat, a human, a monkey, a horse, or a cow.

The RPPs specifically bind SARS-CoV-2 antigens. Examples include but are not limited to, Spike S1 protein, and the receptor binding domain (RBD) of Spike S1 protein. Some RPP compositions are derived from plasma cells or plasmablasts mobilized by, e.g., infection of a donor with COVID-19. In all embodiments, the vaccine mobilizes plasma cells or plasmablasts in the peripheral blood, or causes plasma cells or plasmablasts to be mobilized in the peripheral blood.

A RPP comprises a mixture of ABPs, e.g., antibodies, and can be termed a polyclonal antibody. The mixture of antibodies can comprise 10, 100, 1,000, 10,000, 100,000 or more than 100,000 distinct antibody sequences. In some embodiments, a RPP comprises ABPs having the cognate heavy chain CDR3 and light chain CDR3 sequence disclosed herein.

In some embodiments, the antibodies of the RPP are chimeric. In some embodiments, the antibodies are humanized. In some embodiments, the antibodies are human. In some embodiments, the RPP comprises a mixture of antibody fragments. In some embodiments, the RPPs comprises a mixture of single-chain variable fragments (scFvs). In some embodiments the RPPs comprise full length antibodies. In some embodiments, the antibodies are IgGs, IgAs, or IgMs.

The RPP provided herein can induce various biological effects associated with binding to an antigen that comprises a vaccine. In some embodiments, an RPP provided herein prevents binding of a virus to a cell, which therein prevents entry of the virus into the cell. In some embodiments, the RPP binds to the cell surface of a patient's cells, in order to eliminate cells associated with a pathology.

Also provided are isolated polynucleotides encoding the RPPs provided herein, and portions thereof. In some aspects, the present invention provides a mixture of polynucleotides encoding the RPP provided herein. In other aspects, the present invention provides a mixture of vectors comprising the isolated polynucleotides. In other aspects, the present invention provides a mixture of host cell clones comprising the mixture of polynucleotides or vectors.

Also provided are methods of producing the RPP using the polynucleotides, vectors, or host cells provided herein. Some aspects of the present invention are related to a method of producing RPPs, comprising: expressing the antibodies in host cells using a library of polynucleotide vectors, and isolating the RPP.

Also provided are pharmaceutical compositions comprising the RPPs and a pharmaceutically acceptable excipient.

Also provided are methods of using the RPPs provided herein, e.g., methods of treating or preventing a disease or condition in a subject in need thereof, comprising administering to the subject an effective amount of an RPP provided herein, or a pharmaceutical composition comprising such RPP. In some aspects, the disease or condition is a viral disease, e.g., a COVID-19 infection. In some aspects the method further comprises administering one or more additional therapeutic agents. In some aspects, the additional therapeutic agent is an immune stimulatory or suppressive agent.

In some embodiments, the RPP is in an amount sufficient as prophylaxis against infectious disease when administered to a subject. In some embodiments, the RPP is an amount sufficient to clear infectious disease in an individual actively fighting infection.

In yet a further aspect, the present invention provides for a method for generating a library of recombinant antibodies, comprising: identifying a donor infected with SARS CoV-2; isolating the donor's B cells, plasma cells, or plasmablasts; generating the RPP, i.e., the library of recombinant antibodies from the B cells, plasma cells, or plasmablasts. In some embodiments, the activity of the library of recombinant antibodies exceeds a serum titer activity of said donor against the antigen by at least tenfold. The mammalian donor can comprise more than one individual. In one embodiment, the mammalian donor may be a human, mouse, humanized mouse, rat, humanized rat, horse, or cow. The method of the present invention can generate at least 100 recombinant antibodies, for example at least 1,000 recombinant antibodies, such as at least 10,000 recombinant antibodies. In one embodiment, the method of the present invention generates at least 100,000 recombinant antibodies.

With reference to the method of the present invention, the activity titer may be measured by an in vitro pathogen neutralization assay. Alternatively, the activity titer may be measured by an in vitro binding to antigen assay. In one embodiment, the activity titer may be measured by an in vivo efficacy assay.

In one embodiment, the method of the present invention can further comprise the steps of: obtaining a plurality of first linear polynucleotides, each comprising a first sequence encoding a heavy chain variable domain from a cognate pair from the single B cell, plasma cell, or plasmablast; and a second sequence encoding a light chain variable domain from the cognate pair; and a third sequence linking the first and second sequences and comprising a restriction site; and obtaining a second linear polynucleotide, not operationally linked to the first polynucleotide, comprising a fourth sequence homologous to a portion of the first polynucleotide; and circularizing each of the plurality of first polynucleotides with the second polynucleotide to generate a library of polynucleotides encoding the library of recombinant antibodies, wherein circularization is effected through Gibson Assembly; and expressing the library of recombinant antibodies in mammalian cells comprising the library of polynucleotides encoding the recombinant antibodies, thereby generating the library of recombinant antibodies.

An aspect of the present disclosure provides a recombinant polyclonal protein (RPP) (also called a Recombinant Coronavirus 2 Immune Globulin (rCIG)), comprising at least 100 first antigen binding proteins (ABPs), each of the first ABPs comprising a cognate pair of heavy chain CDR3 and light chain CDR3, wherein each of the first ABPs specifically binds a SARS-CoV-2 receptor binding domain (RBD) or SARS-CoV-2 spike S1.

In some embodiments, each of the first ABPs comprises a heavy chain CDR3 having a sequence selected from SEQ ID Nos: 2, 4, 6, through 8390 (even numbers) and a light chain CDR3 has a sequence selected from SEQ ID Nos: 1, 3, 5, through 8389 (odd numbers).

In some embodiments, each of the first ABPs comprises a heavy chain CDR3 having a sequence selected from SEQ ID Nos: 2, 4, 6, through 4760 (even numbers) and a light chain CDR3 has a sequence selected from SEQ ID Nos: 1, 3, 5, through 4759 (odd numbers). In some embodiments, each of the first ABPs comprises a heavy chain CDR3 having a sequence selected from SEQ ID Nos: 4762, 4764, 4766, through 5082 (even numbers) and a light chain CDR3 has a sequence selected from SEQ ID Nos: 4761, 4763, 4765, through 5081 (odd numbers). In some embodiments, each of the first ABPs comprises a heavy chain CDR3 having a sequence selected from SEQ ID Nos: 5084, 5086, 5088, through 6630 (even numbers) and a light chain CDR3 has a sequence selected from SEQ ID Nos: 5083, 5085, 5087, through 6629 (odd numbers). In some embodiments, each of the first ABPs comprises a heavy chain CDR3 having a sequence selected from SEQ ID Nos: 6632, 6634, 6636, through 8390 (even numbers) and a light chain CDR3 has a sequence selected from SEQ ID Nos: 6631, 6633, 6635, through 8389 (odd numbers). In some embodiments, each of the first ABPs comprises a heavy chain CDR3 having a sequence selected from SEQ ID Nos: 5084, 5086, 5088 through 8390 (even numbers) and a light chain CDR3 has a sequence selected from SEQ ID Nos: 5083, 5085, 5087, through 8389 (odd numbers).

In some embodiments, each of the first ABPs comprises a heavy chain CDR1 having the sequence of GFTX1X2X3X4X5 (SEQ ID NO: 8409). In some embodiments, each of the first ABPs comprises a heavy chain CDR1 having the sequence of GFT[V/F][S/T][S/F/T][N/S/Y][Y/A/G] (SEQ ID NO: 8391). In some embodiments, each of the first ABPs comprises a heavy chain CDR1 having a sequence selected from the group consisting of: a. GFTVS[S/F]NY (SEQ ID NO: 8392), b. GFTFTSSA (SEQ ID NO:

8393), c. GFTFSSYG (SEQ ID NO: 8394), d. GFTVSSNY (SEQ ID NO: 8395), and e. CFTVSTNY (SEQ ID NO: 8396).

In some embodiments, each of the first ABPs comprises a heavy chain CDR2 having the sequence of IX1X2X3GX4X5 (SEQ ID NO: 8397). In some embodiments, each of the first ABPs comprises a heavy chain CDRs having the sequence of I[Y/W/S][S/G/Y][G/S/D]G[S/N/SN][T/K] (SEQ ID NO: 8398). In some embodiments, each of the first ABPs comprises a heavy chain CDR2 having a sequence selected from the group consisting of: a. IYSGGST (SEQ ID NO: 8399), b. IWGSGNT (SEQ ID NO: 8400), c. ISYDGSNK (SEQ ID NO: 8401), d. IYSGGST (SEQ ID NO: 8402), and e. IYSGGST (SEQ ID NO: 8403).

In some embodiments, each of the first ABPs comprises a heavy chain CDR3 having a sequence selected from the group consisting of: a. ARDL[G/S/A][P/A/S][R/A]G[G/Y][I/F]DY (SEQ ID NO: 8404), b. AAPYCSSTSCHDAFDI (SEQ ID NO: 8405), c. AKHGYSYGYWLGYFDY (SEQ ID NO: 8406), d. AR[D/E][C/T/L][L/M][G/V][Y/I][G/P]SMDV (SEQ ID NO: 8407), and e. ARGHWEYYFDY (SEQ ID NO: 8408).

In some embodiments, each of the first ABPs comprises: a. a heavy chain CDR1 having the sequence of GFTVS[S/F]NY (SEQ ID NO: 8392), a heavy chain CDR2 having the sequence of IYSGGST (SEQ ID NO: 8399), and a heavy chain CDR3 having the sequence of ARDL[G/S/A][P/A/S][R/A]G[G/Y][I/F]DY (SEQ ID NO: 8404); b. a heavy chain CDR1 having the sequence of GFTFTSSA (SEQ ID NO: 8393), a heavy chain CDR2 having the sequence of IWGSGNT (SEQ ID NO: 8400), and a heavy chain CDR3 having the sequence of AAPYCSSTSCHDAFDI (SEQ ID NO: 8405); c. a heavy chain CDR1 having the sequence of GFTFSSYG (SEQ ID NO: 8394), a heavy chain CDR2 having the sequence of ISYDGSNK (SEQ ID NO: 8401), and a heavy chain CDR3 having the sequence of AKHGYSYGYWLGYFDY (SEQ ID NO: 8406); d. a heavy chain CDR1 having the sequence of GFTVSSNY (SEQ ID NO: 8395), a heavy chain CDR2 having the sequence of IYSGGST (SEQ ID NO: 8402), and a heavy chain CDR3 having the sequence of AR[D/E][C/T/L][L/M][G/V][Y/I][G/P]SMDV (SEQ ID NO: 8407); or e. a heavy chain CDR1 having the sequence of CFTVSTNY (SEQ ID NO: 8396), a heavy chain CDR2 having the sequence of IYSGGST (SEQ ID NO: 8403), and a heavy chain CDR3 having the sequence of ARGHWEYYFDY (SEQ ID NO: 8408).

In some embodiments, each of at least 5%, 10%, 25%, or 50% of the total ABPs in the RPP comprises: a. a heavy chain CDR1 having the sequence of GFTVS[S/F]NY (SEQ ID NO: 8392), a heavy chain CDR2 having the sequence of IYSGGST (SEQ ID NO: 8399), and a heavy chain CDR3 having the sequence of ARDL[G/S/A][P/A/S][R/A]G[G/Y][I/F]DY (SEQ ID NO: 8404); b. a heavy chain CDR1 having the sequence of GFTFTSSA (SEQ ID NO: 8393), a heavy chain CDR2 having the sequence of IWGSGNT (SEQ ID NO: 8400), and a heavy chain CDR3 having the sequence of AAPYCSSTSCHDAFDI (SEQ ID NO: 8405); c. a heavy chain CDR1 having the sequence of GFTFSSYG (SEQ ID NO: 8394), a heavy chain CDR2 having the sequence of ISYDGSNK (SEQ ID NO: 8401), and a heavy chain CDR3 having the sequence of AKHGYSYGYWLGYFDY (SEQ ID NO: 8406); d. a heavy chain CDR1 having the sequence of GFTVSSNY (SEQ ID NO: 8395), a heavy chain CDR2 having the sequence of IYSGGST (SEQ ID NO: 8402), and a heavy chain CDR3 having the sequence of AR[D/E][C/T/L][L/M][G/V][Y/I][G/P]SMDV (SEQ ID NO: 8407); or e. a heavy chain CDR1 having the sequence of CFTVSTNY (SEQ ID NO: 8396), a heavy chain CDR2 having the sequence of IYSGGST (SEQ ID NO: 8403), and a heavy chain CDR3 having the sequence of ARGHWEYYFDY (SEQ ID NO: 8408).

In some embodiments, each of the first ABPs comprises a unique heavy chain CDR3 and a unique light chain CDR3 sequence.

In some embodiments, the RPP comprises 100 to 500 first ABPs. In some embodiments, the RPP comprises 500 to 1000 first ABPs. In some embodiments, the RPP comprises 1000 to 2500 first ABPs. In some embodiments, the RPP comprises more than 2500 first ABPs.

In some embodiments, the RPP further comprises at least 100 second ABPs, wherein each of the second ABPs specifically binds an antigen of SARS-CoV-2, optionally wherein the antigen of SARS-CoV-2 is not a SARS-CoV-2 receptor binding domain (RBD) or SARS-CoV-2 spike S1.

In some embodiments, the RPP comprises at least 250, 500, 750, 1000, or 5000 second ABPs.

In some embodiments, the RPP comprises at least 1000, 5000, 10,000, or 50,000 ABPs in total.

In some embodiments, each of the first ABPs comprises a scFv. In some embodiments, each of the first ABPs is a full-length antibody. In some embodiments, each of the first ABPs is a human IgG1 subtype. In some embodiments, each of the first ABPs is produced in eukaryotic cell culture. In some embodiments, each of the first ABPs is produced in yeast cells. In some embodiments, each of the first ABPs is produced in a CHO cell.

In some embodiments, the RPP is recombinantly produced using sequences derived from B cells, plasma cells, or plasmablasts in a sample from a donor injected with the SARS-CoV-2 receptor binding domain (RBD) or SARS-CoV-2 spike S1 or infected with SARS CoV-2, optionally wherein the donor is a human. In some embodiments, each of the first ABPs is recombinantly produced using sequences derived from B cells, plasma cells, or plasmablasts in a sample from more than one donors injected with the SARS-CoV-2 receptor binding domain (RBD) or SARS-CoV-2 spike S1 or infected with SARS CoV-2, optionally wherein the donors are humans.

In some embodiments, a binding titer of the RPP is at least 50 times higher than an average binding titer of antibodies in a serum sample from the same donor, wherein the binding titer is measured by anti-SARS-CoV-2-ELISA. In some embodiments, an average binding titer of the RPP is at least 100, 200, 300, 400, 500, 600, 700, 800, 900, or 1000 times higher than an average binding titer of the serum sample, wherein the binding titer is measured by anti-SARS-CoV-2-ELISA.

In some embodiments, a neutralization titer of the RPP is at least 50 times higher than an average neutralization titer of antibodies in a serum sample from the same donor, wherein the neutralization titer is measured by an in vitro assay. In some embodiments, a neutralization titer of the RPP is at least 100, 200, 300, 400, 500, 600, 700, 800, 900, or 1000 times higher than an average neutralization titer of antibodies in the sample, wherein the neutralization titer is measured by an in vitro assay.

In another aspect, the present disclosure provides a pharmaceutical composition comprising the RPP described herein and a pharmaceutically acceptable excipient.

In yet another aspect, the present disclosure provides a method of treating a subject in need thereof, the method comprising administering to the subject an effective amount of the RPP or the pharmaceutical composition described herein. In some embodiments, the subject has a viral infection, optionally a SARS CoV-2 infection. In some embodiments, the method further comprises administration of one or more agents.

In one aspect, the present disclosure provides a plurality of isolated polynucleotides, each polynucleotide encoding an ABP of the RPP described herein. In another aspect, the present disclosure provides a plurality of isolated vectors, each vector comprising a polynucleotide encoding an ABP of the RPP described herein. In some embodiments, the vector is an expression vector.

In yet another aspect, the present disclosure provides a plurality of host cells comprising the plurality of isolated polynucleotides or the plurality of isolated vectors provided herein.

Also provided is a method of producing the RPP, the method comprising culturing the host cells described herein under conditions for expression of the RPP and isolating the RPP. In some embodiments, the RPP comprises full-length antibodies and the host cells are CHO cells. In some embodiments, the RPPs comprises scFvs and the host cells are CHO cells.

The present disclosure further provides an isolated polypeptde comprising a cognate pair of heavy chain CDR3 and light chain CDR3, wherein the heavy chain CDR3 has a sequence selected from SEQ ID Nos: 2, 4, 6, through 8390 (even numbers) and the light chain CDR3 has a sequence selected from SEQ ID Nos: 1, 3, 5, through 8389 (odd numbers). In some embodiments, the isolated polypeptide comprises a heavy chain CDR3 having the sequence of SEQ ID NO: [n+1] and a light chain CDR3 having the sequence of SEQ ID NO: [n], wherein n is an odd number from 1 to 8389.

The present disclosure additionally provides an isolated polypeptde comprising a cognate pair of heavy chain and light chain, wherein a. a heavy chain CDR1 having the sequence of GFTVS[S/F]NY (SEQ ID NO: 8392), a heavy chain CDR2 having the sequence of IYSGGST (SEQ ID NO: 8399), and a heavy chain CDR3 having the sequence of ARDL[G/S/A][P/A/S][R/A]G[G/Y][I/F]DY (SEQ ID NO: 8404); b. a heavy chain CDR1 having the sequence of GFTFTSSA (SEQ ID NO: 8393), a heavy chain CDR2 having the sequence of IWGSGNT (SEQ ID NO: 8400), and a heavy chain CDR3 having the sequence of AAPYCSST-SCHDAFDI (SEQ ID NO: 8405); c. a heavy chain CDR1 having the sequence of GFTFSSYG (SEQ ID NO: 8394), a heavy chain CDR2 having the sequence of ISYDGSNK (SEQ ID NO: 8401), and a heavy chain CDR3 having the sequence of AKHGYSYGYWLGYFDY (SEQ ID NO: 8406); d. a heavy chain CDR1 having the sequence of GFTVSSNY (SEQ ID NO: 8395), a heavy chain CDR2 having the sequence of IYSGGST (SEQ ID NO: 8402), and a heavy chain CDR3 having the sequence of AR[D/E][C/T/L][L/M][G/V][Y/I][G/P]SMDV (SEQ ID NO: 8407); or e. a heavy chain CDR1 having the sequence of CFTVSTNY (SEQ ID NO: 8396), a heavy chain CDR2 having the sequence of IYSGGST (SEQ ID NO: 8403), and a heavy chain CDR3 having the sequence of ARGHWEYYFDY (SEQ ID NO: 8408).

In one aspect, the present disclosure provides an isolated polynucleotide encoding the isolated polypeptide described above.

In another aspect, the present disclosure provides a cell comprising the isolated polypeptide or the isolated polynucleotide of the present disclosure.

In yet another aspect, the present disclosure provides a method of generating a recombinant polyclonal proteins (RPP) (also called a Recombinant Coronavirus 2 Immune Globulin (rCIG)), comprising a. providing B cells, plasma cells, or plasmablasts of a donor exposed to an antigen of SARS-CoV-2; b. amplifying a cognate pair of polynucleotides encoding a light chain variable region and a heavy chain variable region from a single cell out of the plasma cells or plasmablasts by overlap extension reverse transcriptase polymerase chain reaction (OE-RT-PCR); c. cloning polynucleotides obtained from the amplification into expression vectors, thereby obtaining constructs encoding the RPP; d. expressing the RPP from the constructs; e. enriching a subset of the constructs based on activity of the RPP or a member of the RPP against SAR-CoV-2; and f. obtaining the RPP (also called a Recombinant Coronavirus 2 Immune Globulin (rCIG)).

The present disclosure provides an RPP (also called a Recombinant Coronavirus 2 Immune Globulin (rCIG)) obtained by the method described herein. The present disclosure also provides a Recombinant Coronavirus 2 Immune Globulin (rCIG) produced using the methods described in Example 2.

One aspect of the present disclosure provides a method for producing an rCIG as described in Example 2. Another aspect of the present disclosure provides an rCIG produced using the methods described in Example 3. In yet another aspect, the present disclosure provides a method for producing an rCIG as described in Example 3.

6. BRIEF DESCRIPTION OF THE DRAWINGS AND TABLES

This patent or application file contains at least one drawing executed in color. Copies of this patent or patent application publication with color drawing(s) will be provided by the Office upon request and payment of the necessary fee.

FIG. 1 illustrates construct PMD-4681 used for random integration into CHOZN cells.

FIGS. 2A and 2B summarize the steps used to generate libraries of scFv constructs. (FIG. 2A) First, IgH and IgK mRNA transcripts are reverse transcribed into cDNA and then amplified with a pool of VH, VK, CHL and CK1 primers. (FIG. 2B) The CK1 and VH primers have linkers, which drive fusion of the individual IgH and IgK amplicons into a linked scFv construct. This construct is used for cloning into antibody expression construct libraries.

FIG. 3A to 3D are tables with characteristics of the donors used to create candidate RPP libraries. SOB=shortness of breath; ST=sore throat.

FIG. 5 is a table with a list of assays used to characterize the rCIG RPP candidate.

FIG. 6 is a table with results of assays used to characterize rCIG RPPs.

Figure 8A:
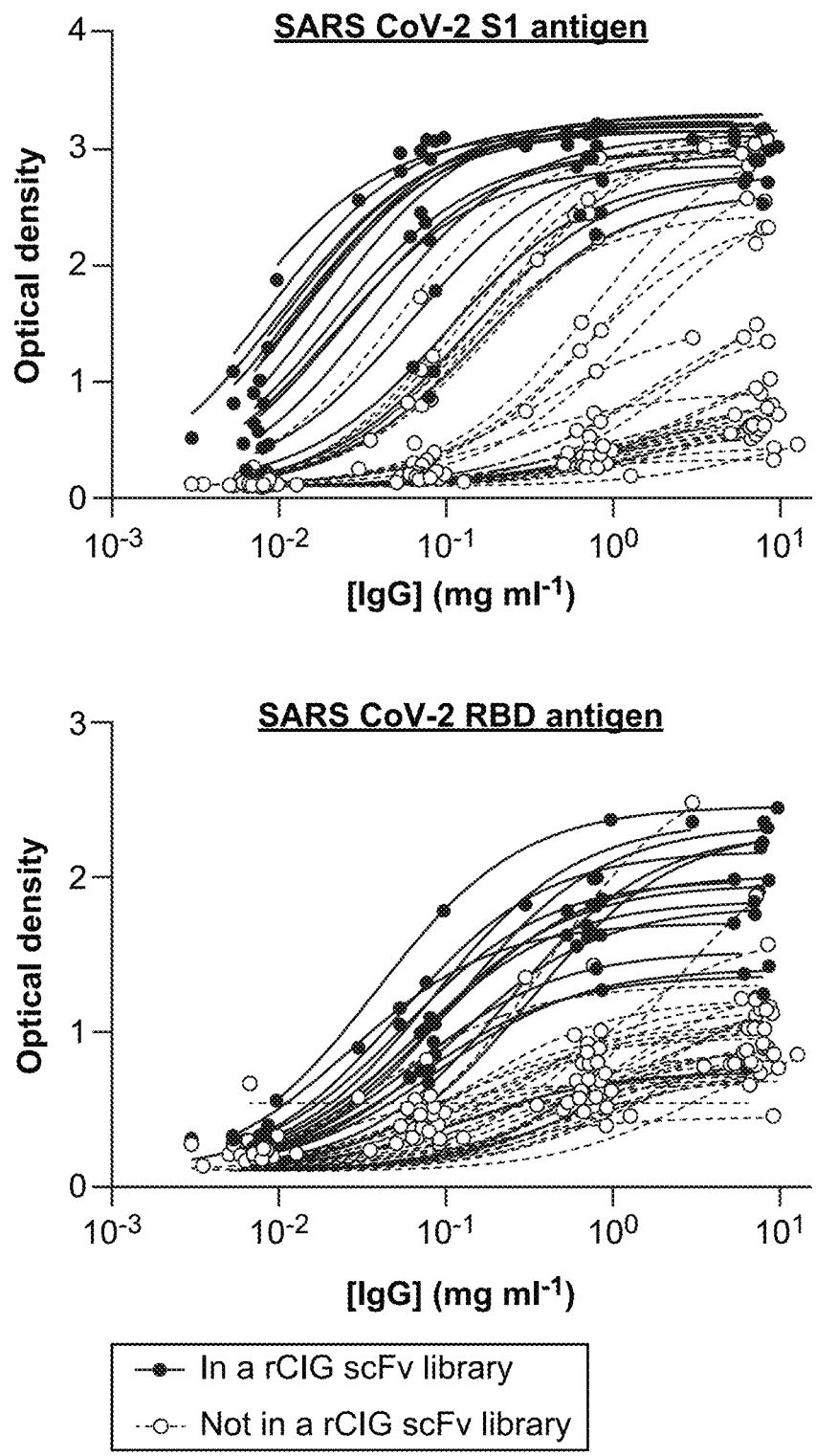

FIG. 8A provides optical density measured by ELISA of individual human plasma donors against SARS-CoV-2 S1 antigen (top) or RBD antigen (bottom). Each data point represents a single measurement at a single test article dilution in a single experiment.

Figure 8B:
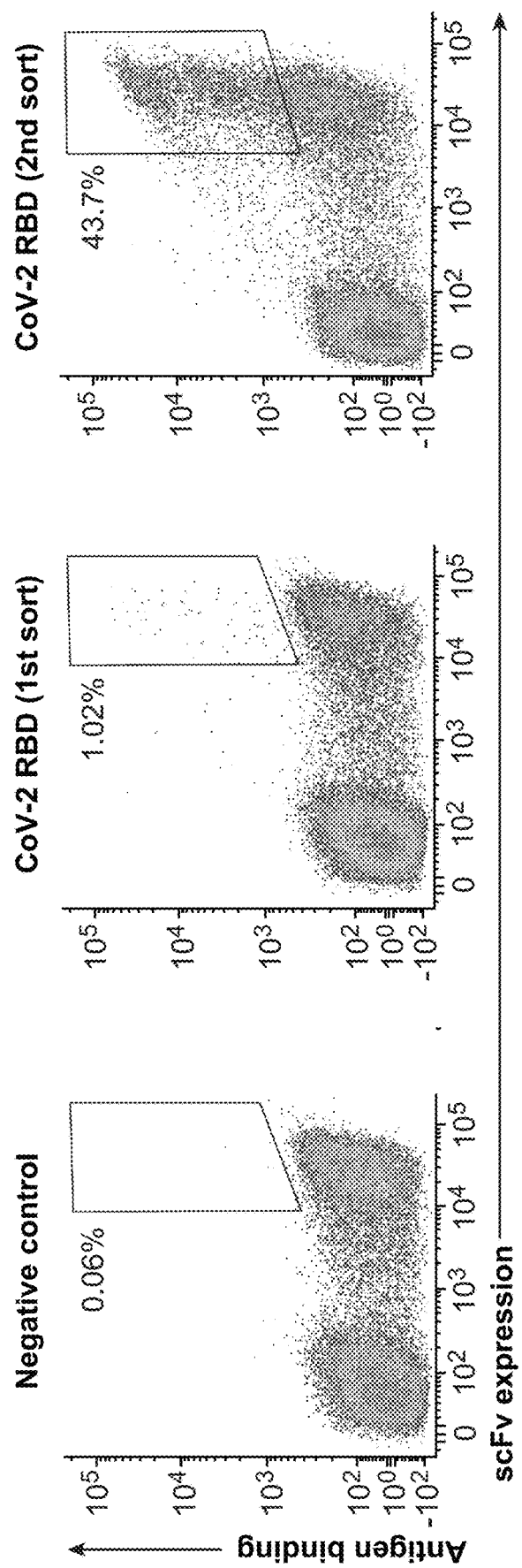

FIG. 8B shows FACS enrichment of scFv against CoV-2 RBD from library 1 using yeast display. The x axis measures presence of a C-terminal c-Myc tag, indicating expression of an scFv on the surface of the cell. The y axis measures binding of antigen to the scFv-expressing cells. The gates used for yeast selection (double positive) are indicated, with the percentage of scFv-expressed antigen binders in greyscale. Each plot summarizes a single FACS experiment with one yeast scFv library.

Figure 8C:
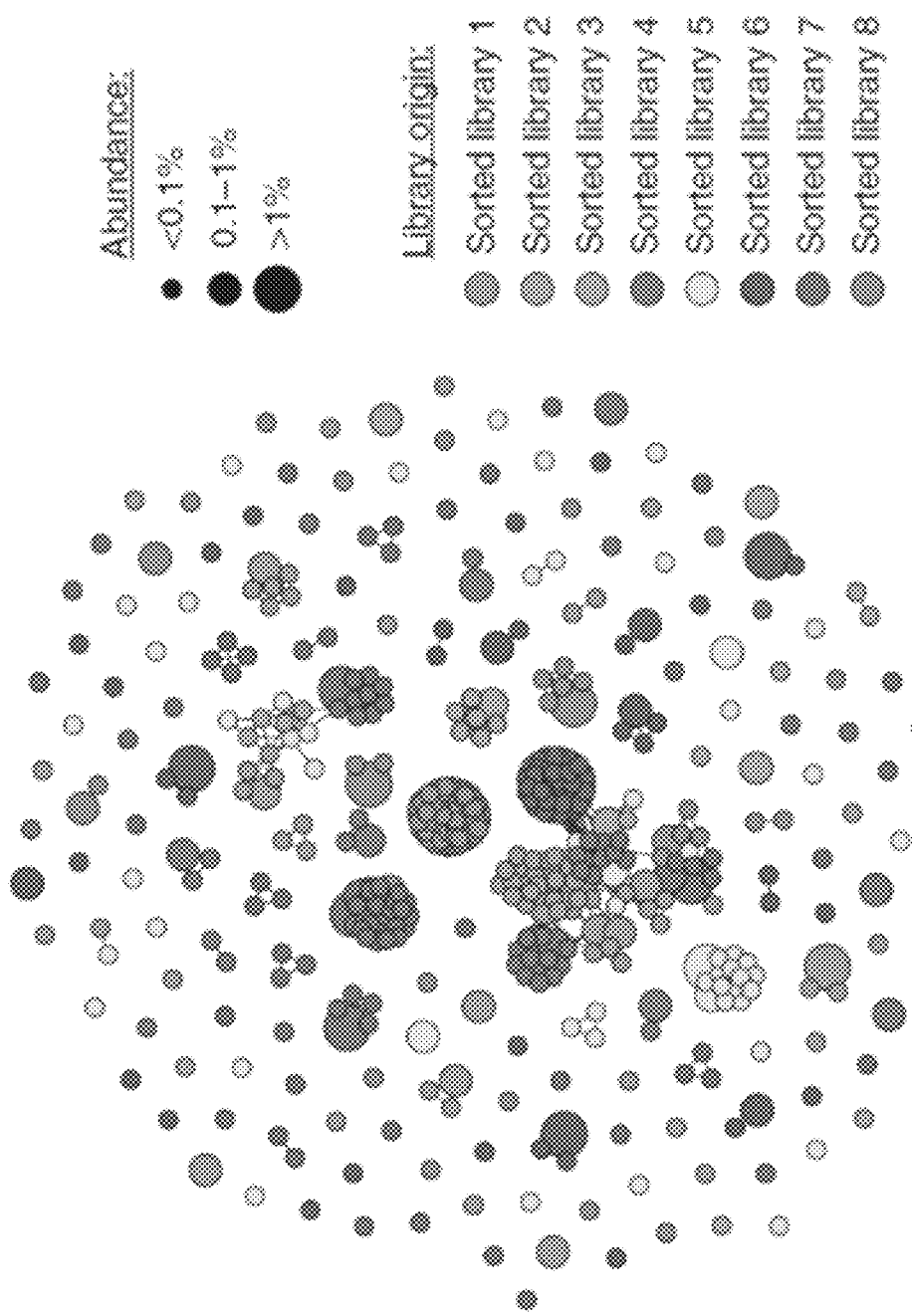

FIG. 8C provides clonal cluster analysis of rCIG antibodies. Each node represents an antibody clone (full-length heavy chain). The greyscale shades of the nodes indicate the sorted scFv library from which the CHO antibody clones were derived. The size of the nodes reflects the frequency of the clones in the final CHO cell bank (only clones ≥0.01% are plotted). The total number of amino acid differences between each pairwise alignment, and edges indicate ≤5 amino acid differences were computed.

Figure 8D:
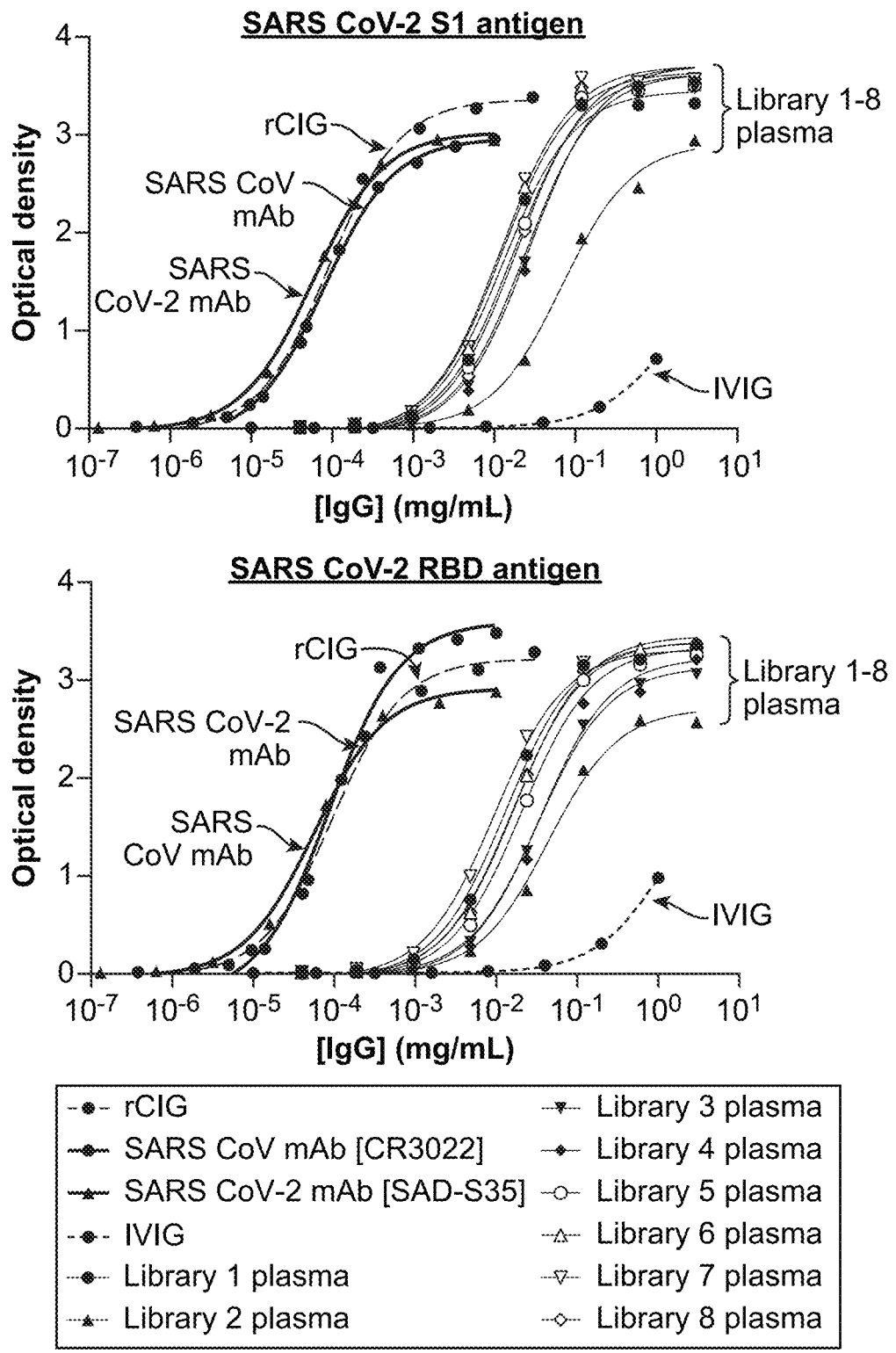

FIG. 8D provides optiocal density measured by ELISA of the indicated samples against SARS-CoV-2 S1 antigen (top) or RBD antigen (bottom). Each data point represents a single measurement at a single test article dilution, in a single experiment.

Figure 8E:
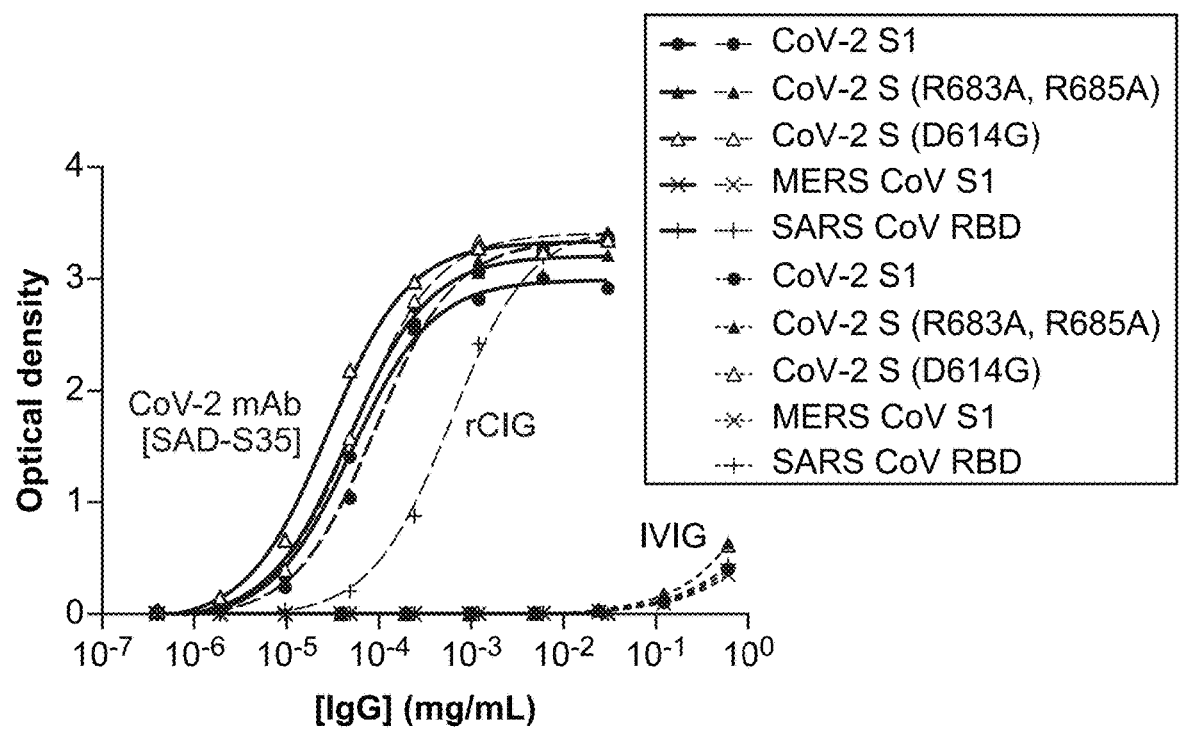

FIG. 8E provides optical density measured by ELISA of the indicated samples against the indicated antigens (different shapes). For rCIG, no binding was observed against MERS CoV S1. For the CoV-2 mAb (SAD-S35), no binding was observed against MERS CoV S1 and SARS-CoV RBD. Each data point represents a single measurement at a single test article dilution, in a single experiment.

Figure 8F:
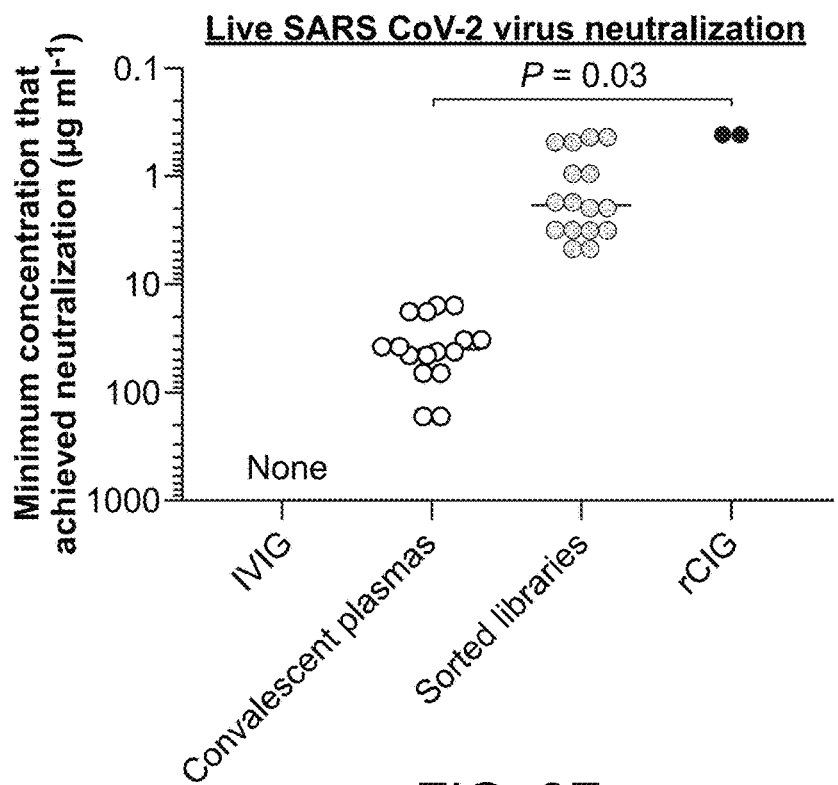

FIG. 8F shows live virus neutralization. Individual dots are separate test articles that represent the minimum antibody concentration that achieved neutralization. Bars represent median measurements for each test article category. Each test article was run in duplicate using different aliquots of cells and virus, in a single experiment, with the same result observed for each replicate. No neutralization was seen for IVIG. A Wilcoxon rank sum test was used to compare the minimum concentration to achieve SARS-CoV-2 live virus neutralization between convalescent plasma measurements (n=16) and rCIG measurements (n=2).

Figure 9A:
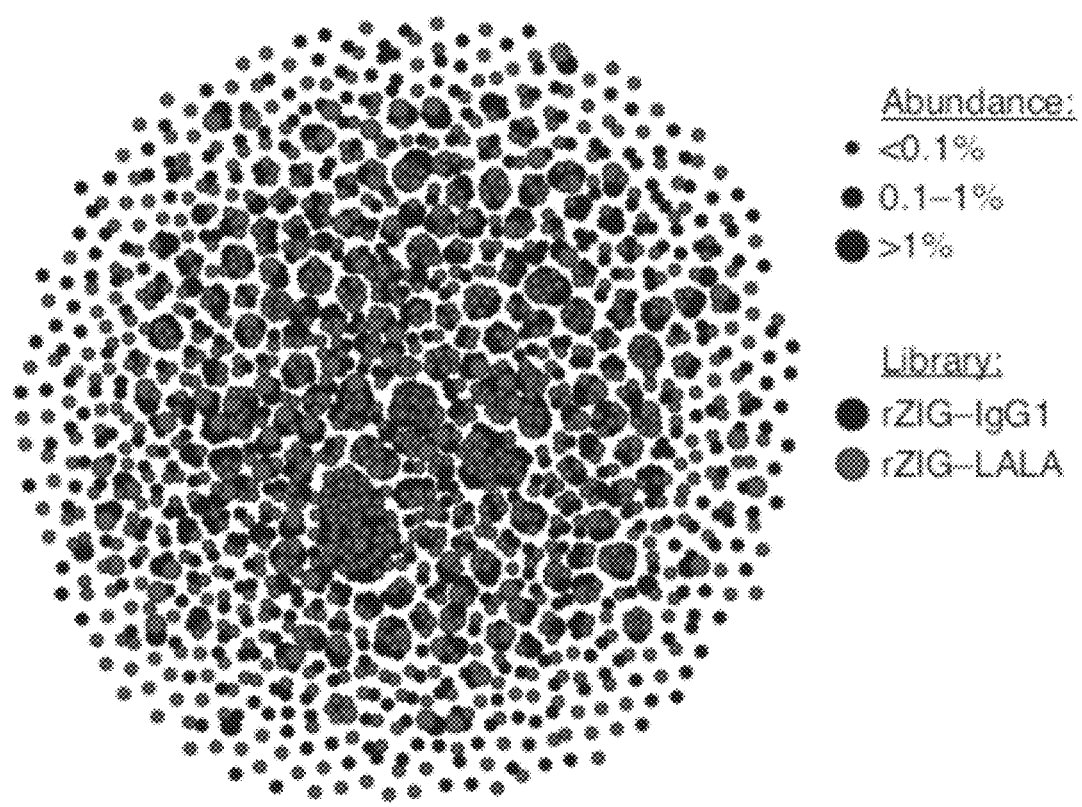

FIG. 9A shows clonal cluster analysis of rZIG-IgG1 and rZIG-LALA antibodies. Each node represents an antibody clone (full-length heavy chain). The size of the nodes reflects the frequency of the clones in the final CHO cell bank (only clones ≥0.01% are plotted). The total number of amino acid differences between each pairwise alignment was computed after combining both libraries together, and edges indicate ≤5 amino acid differences.

FIG. 9B provides ELISA results of rZIG-IgG1, rZIG-LALA, and Zika/dengue+ serum control for dengue serotypes 1-4 (y axis, indicated by shape) and Zika virus antigen (x axis). Each data point represents a single test article measured against a single dengue serotype. Linear regression trendline is indicated in black. Simple linear regression was used to calculate the coefficient of determination (R2) between Zika and dengue ELISA $EC_{50}$ values (n=7, in a single experiment). EC50 values for all dengue serotypes were pooled for the analysis. Significance of the regression model was determined using an F-statistic with 1 and 10 d.f.

FIG. 9C shows pseudotype neutralization by rZIG-IgG1, rZIG-LALA, and Zika/dengue+ serum control for dengue serotypes 1-4 (y axis, indicated by shape) and Zika virus antigen (x axis). Each data point represents a single test article measured against a single dengue serotype, in a single experiment. Linear regression trendline is indicated in black. Simple linear regression was used to calculate the coefficient of determination (R2) between Zika and dengue pseudotype neutralization $IC_{50}$ values (n=11). $IC_{50}$ values for all dengue serotypes were pooled for the analysis. Significance of the regression model was determined using an F-statistic with 1 and 10 d.f.

Figure 9D:
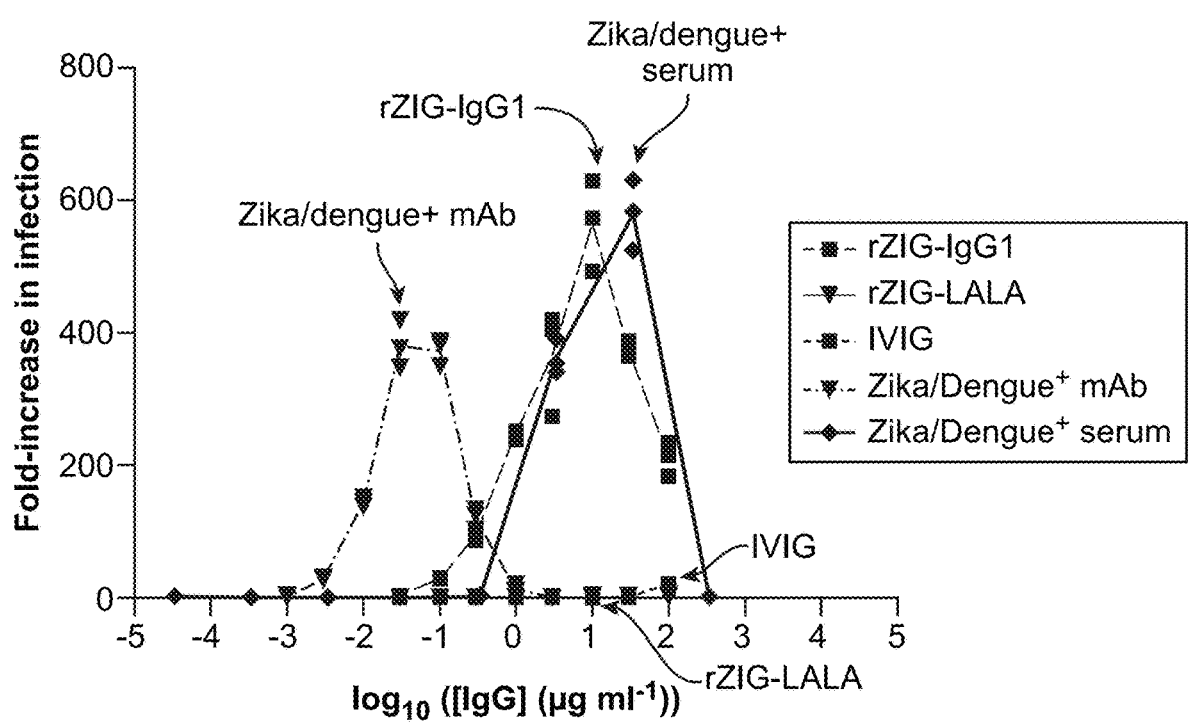

FIG. 9D shows Zika pseudotype virus ADE assay results for rZIG-IgG1, rZIG-LALA, and positive and negative controls. Test article concentration is on the x axis. Fold-increase infection is on they axis, which was the infection-induced luciferase signal observed in the presence of antibody divided by the luciferase signal observed with a no-antibody control. Each data point represents a single measurement at a single test article dilution, in a single experiment.

FIG. 10A shows clonal cluster analysis of rHIG and rPIG antibodies. Each node represents an antibody clone (full-length heavy chain). The size of the nodes reflects the frequency of the clones in the final CHO cell bank (only clones ≥0.01% are plotted). The total number of amino acid differences between each pairwise alignment, and edges indicate ≤5 amino acid differences were computed.

Figure 10B:
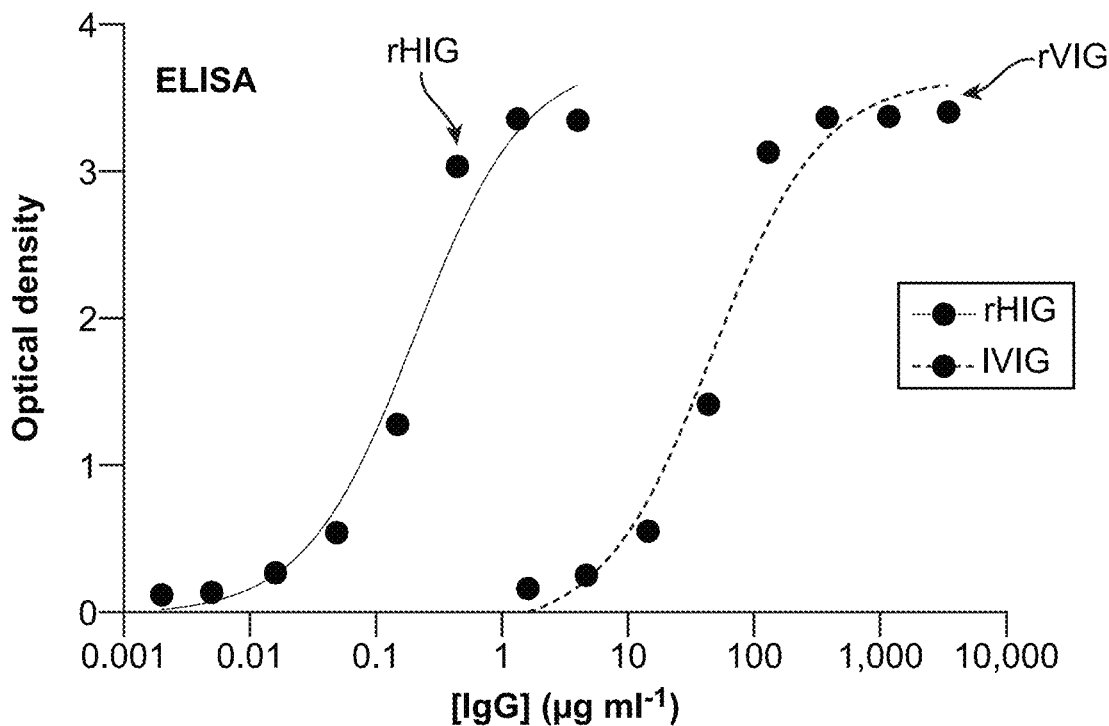

FIG. 10B shows optical density (y-axis) measure by Anti-Hib ELISA for rHIG and IVIG. Each data point represents a single measurement at a single test article dilution, in a single experiment.

Figure 10C:
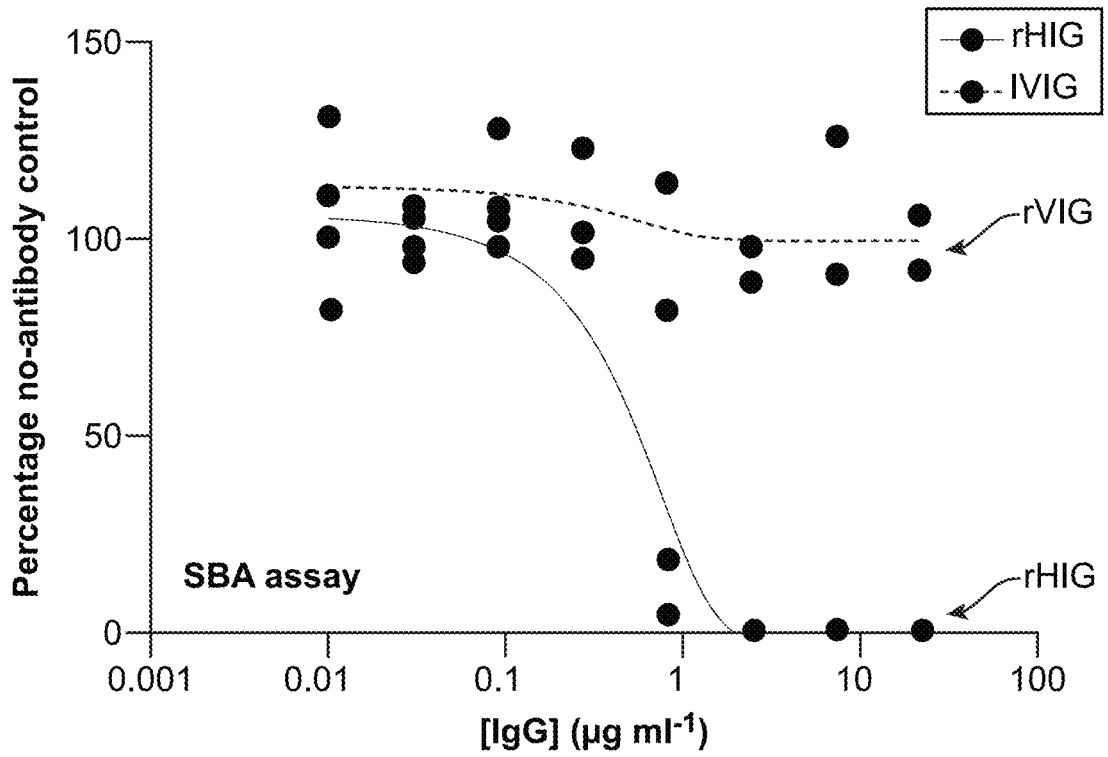

FIG. 10C shows results from serum bactericidal assay (SBA) for rHIG and IVIG with the ATCC 10211 Hib strain. Percentage of no-antibody control (y axis) was computed as the number of bacterial colonies in the test sample divided by the number of bacterial colonies in a no-antibody control sample. Each data point represents a single measurement at a single test article dilution, in a single experiment.

Figure 10D:
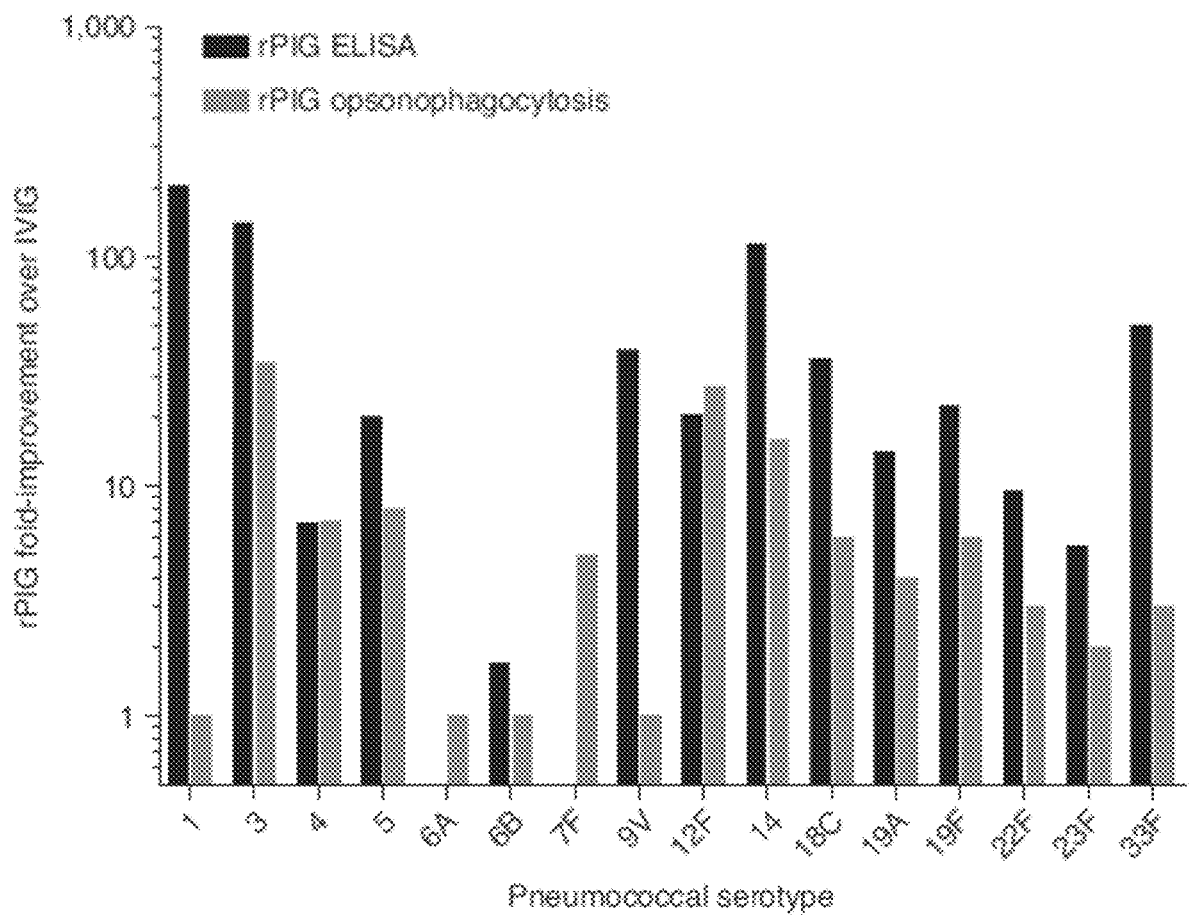

FIG. 10D shows rPIG fold-improvement over IVIG (y-axis) with respect to ELISA binding to (dark shade) or opsonophagocytosis of (light shade) the indicated pneumococcal serotype (x-axis). Fold improvement in binding/activity over IVIG was computed as a mean of duplicate measurements for rPIG divided by a mean of duplicate measurements for IVIG (based on the binding concentration for ELISA and the number of bacterial colonies for opsonophagocytosis). Fold improvement over IVIG, by assay (ELISA or opsonophagocytosis) was tested using a one-sample Wilcoxon signed rank test, with the null hypothesis that the median equals 1, that is, $H_0$=1. For each assay, all individual serotypes were pooled a single Wilcoxon signed rank test. Values for each individual serotype were generated by dividing the mean of duplicate rPIG measurements by the mean of duplicate IVIG measurements.

FIG. 10E provides in vivo assay data with ATCC 10211 Hib strain. Each circle represents CFU Hib per ml (y axis) from either peritoneal fluid or blood from a single mouse in a given test group. Black bars represent mean of the CFU Hib per ml. Dotted lines represent the lower limit of detection for CFU quantification. Welch's t-tests were used to compare CFU Hib per ml between test groups (n=8 mice per group, in a single experiment). d.f. were 7.87 for IVIG+rHIG/rPIG (500 mg $kg^{-1}$) and 7.13 for IVIG+rHIG/rPIG (200 mg kg$^{-1}$) in peritoneal fluid. d.f. were 10.87 for IVIG+rHIG/Rpig (500 mg kg$^{-1}$) and 8.03 for IVIG+rHIG/rPIG (200 mg kg$^{-1}$) in blood.

Figure 11A:
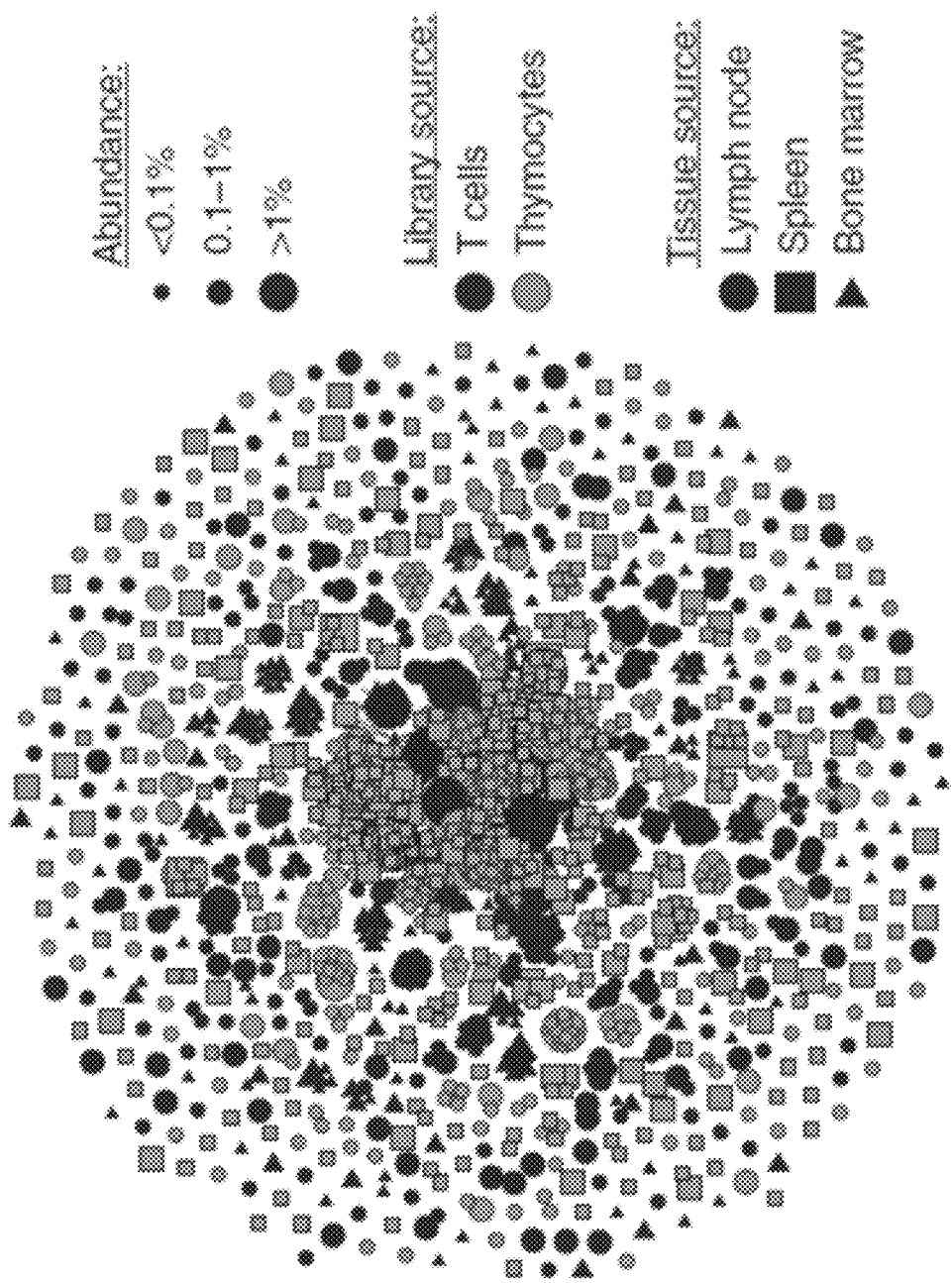

FIG. 11A provides clonal cluster analysis of rhATG antibodies. Each node represents an antibody clone (full-length heavy chain). The color of the nodes indicates the immunized library source. The shape of the nodes indicates the mouse tissue origin. The size of the nodes reflects the frequency of the clones in the final CHO cell bank (only clones ≥0.01% are plotted). The total number of amino acid differences between each pairwise alignment, and edges indicate ≤5 amino acid differences were computed.

Figure 11B:
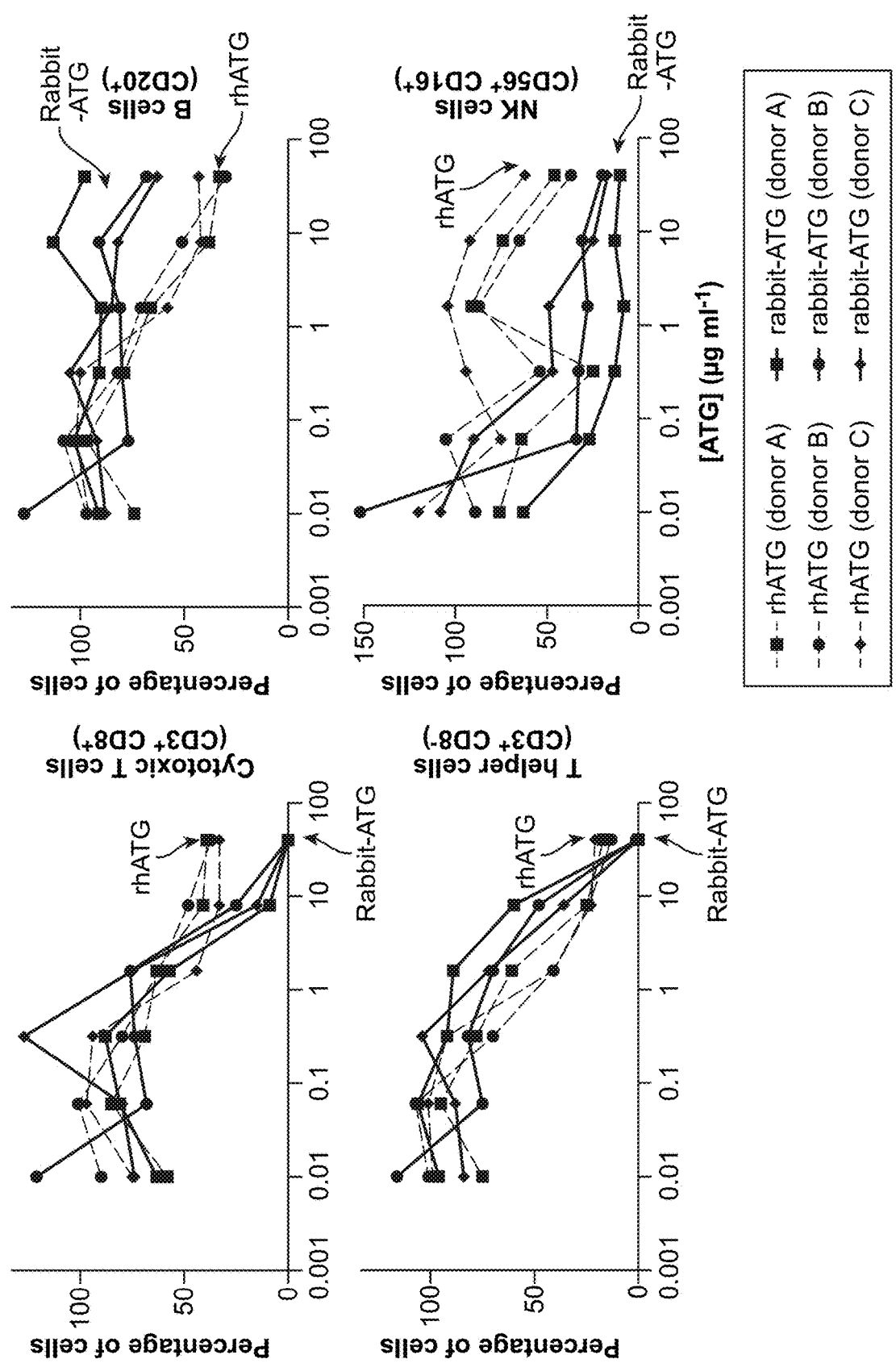

FIG. 11B shows results from cell killing assays of a dilution series of rabbit-ATG and rhATG with three PBMC donors. They axis (% cells) was determined by dividing the number of cells of the indicated cell type present after overnight incubation with the indicated amount of antibody by the number of cells of that cell type present in a no-antibody control. Each data point represents a single measurement at a single test article dilution, in a single experiment. Linear mixed effects models were used to compute P values for each of the four cell types, with group and concentration as fixed effects and PBMC donor as a random effect to account for the dependence of repeated measures. d.f. were 31 for each of the four models. NK, natural killer.

Figures 11C, 11D:
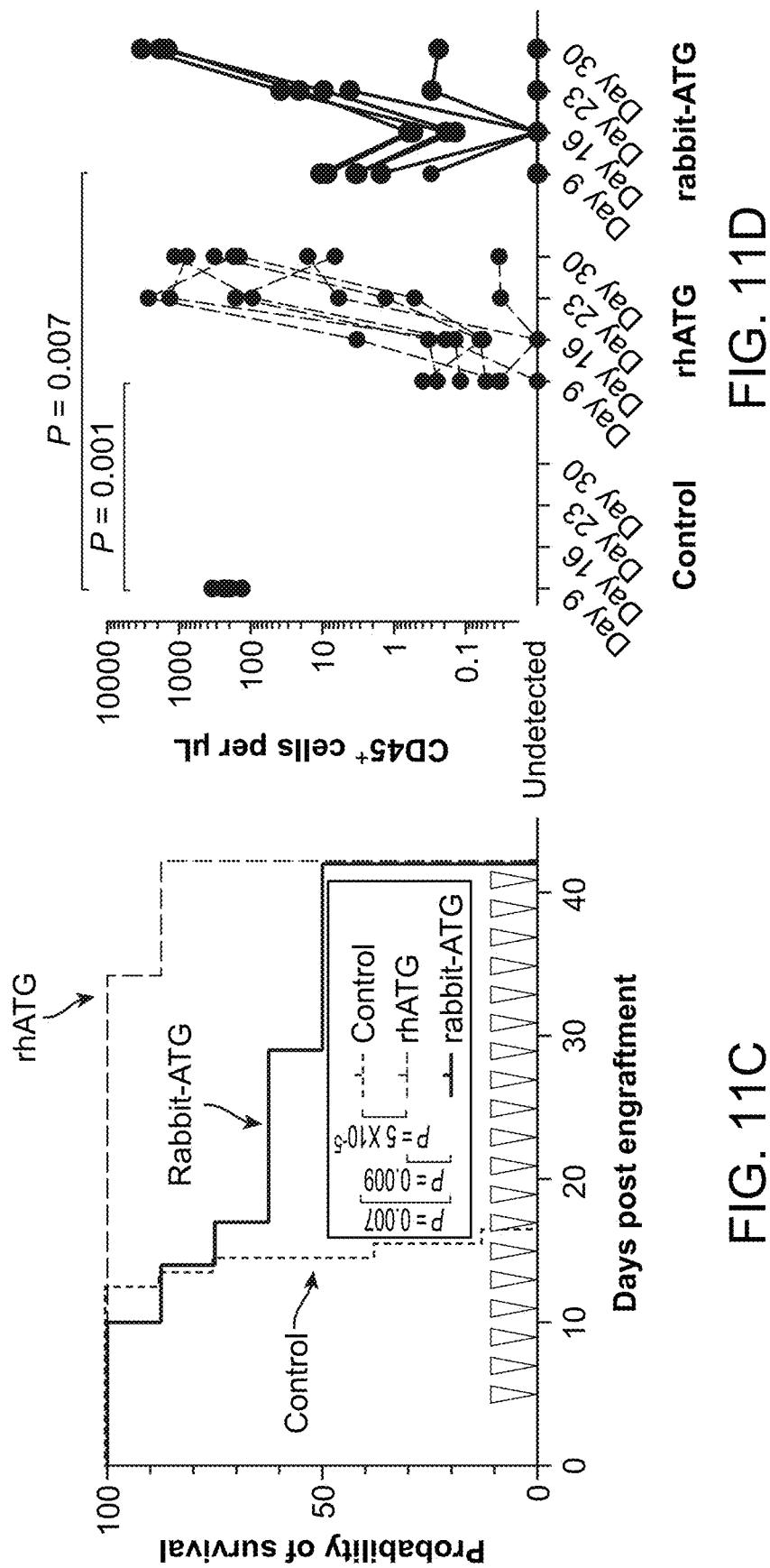

FIG. 11C shows survival of mice (n=8 per treatment group, in a single experiment) in the GVH study using PBMC donor 1 treated every other day with a negative vehicle control, rabbit-ATG or rhATG. Treatment days are indicated by green triangles. Kaplan-Meier survival models were fit on time to mortality and pairwise log-rank tests were performed to compare median survival between treatment groups.

FIG. 11D shows the concentration of CD45+ cells determined by flow cytometry in each alive mouse on days 9, 16, 23 and 30 of the GVH study from FIG. 11C for negative vehicle control, rhATG or rabbit-ATG. Lines connect measurements from each mouse. No CD45+ cells were observed where circles intercept the x axis. Linear mixed effects models were used to compute P values for trends in CD45+ cell counts in each of the four GVH experiments (2 PBMC donors×2 drug dosing regimens=4 experiments) with day as a fixed effect and PBMC donor as a random effect to account for the dependence of repeated measures. A Wilcoxon rank sum test was used to compare CD45+ cell counts on day 9 for saline negative control versus rhATG and saline negative control versus rabbit-ATG, in each of the four GVH experiments (2 PBMC donors×2 drug dosing regimens=4 experiments).

Figure 12A:
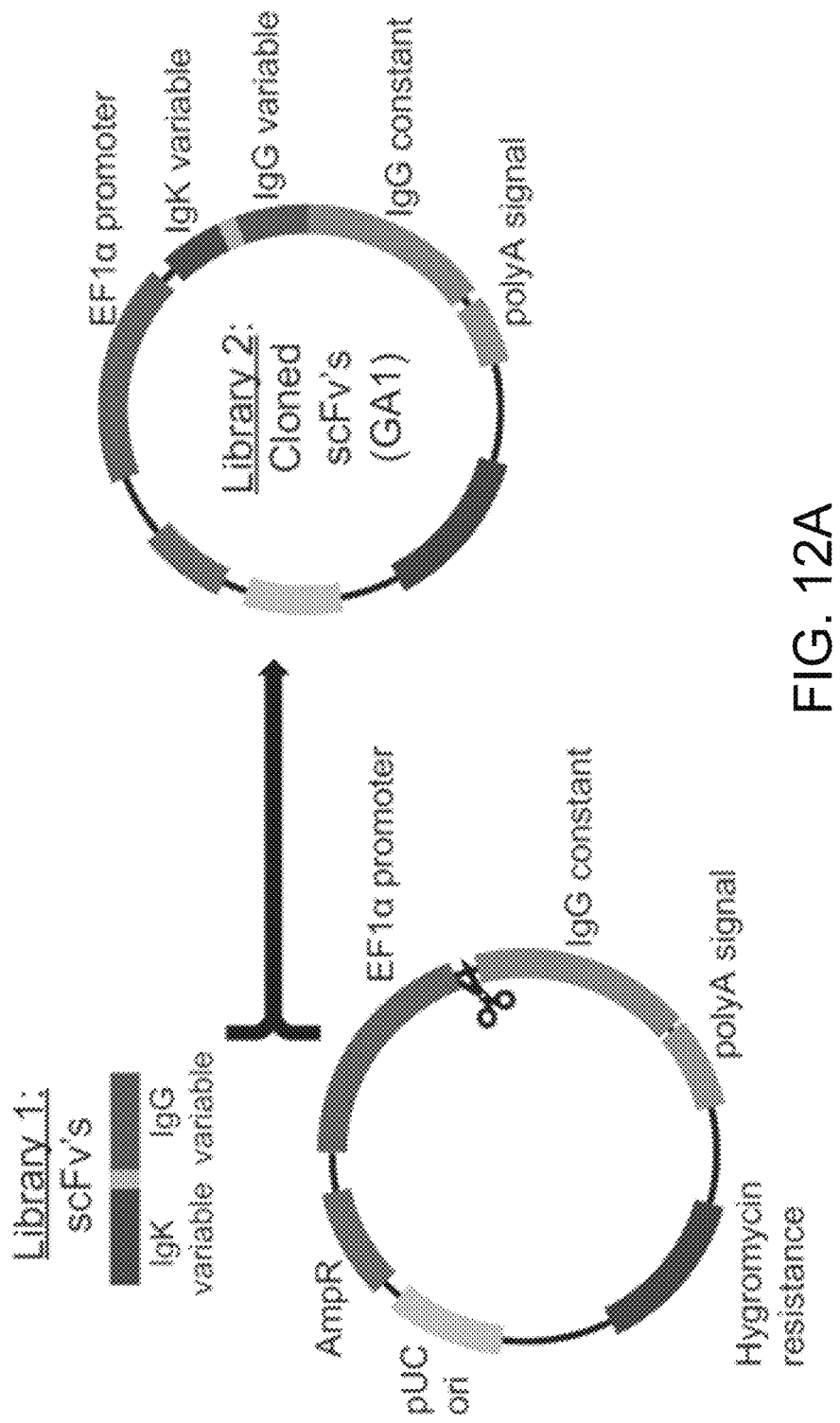
Figure 12B:
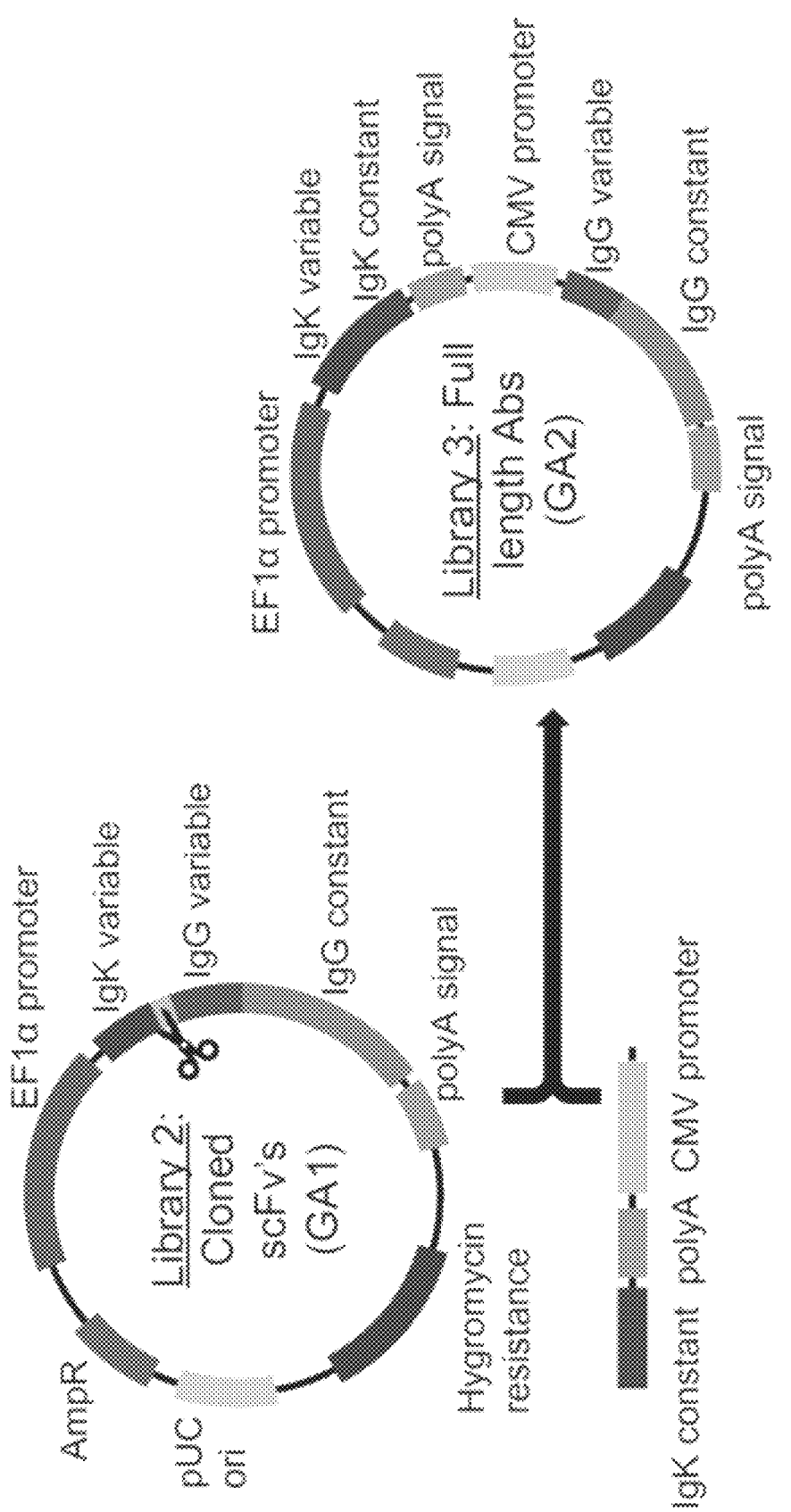

FIGS. 12A and 12B provide schematic of Gibson assembly processes. (FIG. 12A) Product of Gibson Assembly 1 (GA1), comprising the based plasmid vector with an scFv (from Library 1) cloned between the EF1α promoter and the IgG constant domain sequence. (FIG. 12B) Product of Gibson Assembly 2 (GA2), with the scFv linker excised and replaced with a sequence that comprises an IgK constant domain sequence, a poly(A) signal sequence, and a CMV promoter.

Figure 13A:
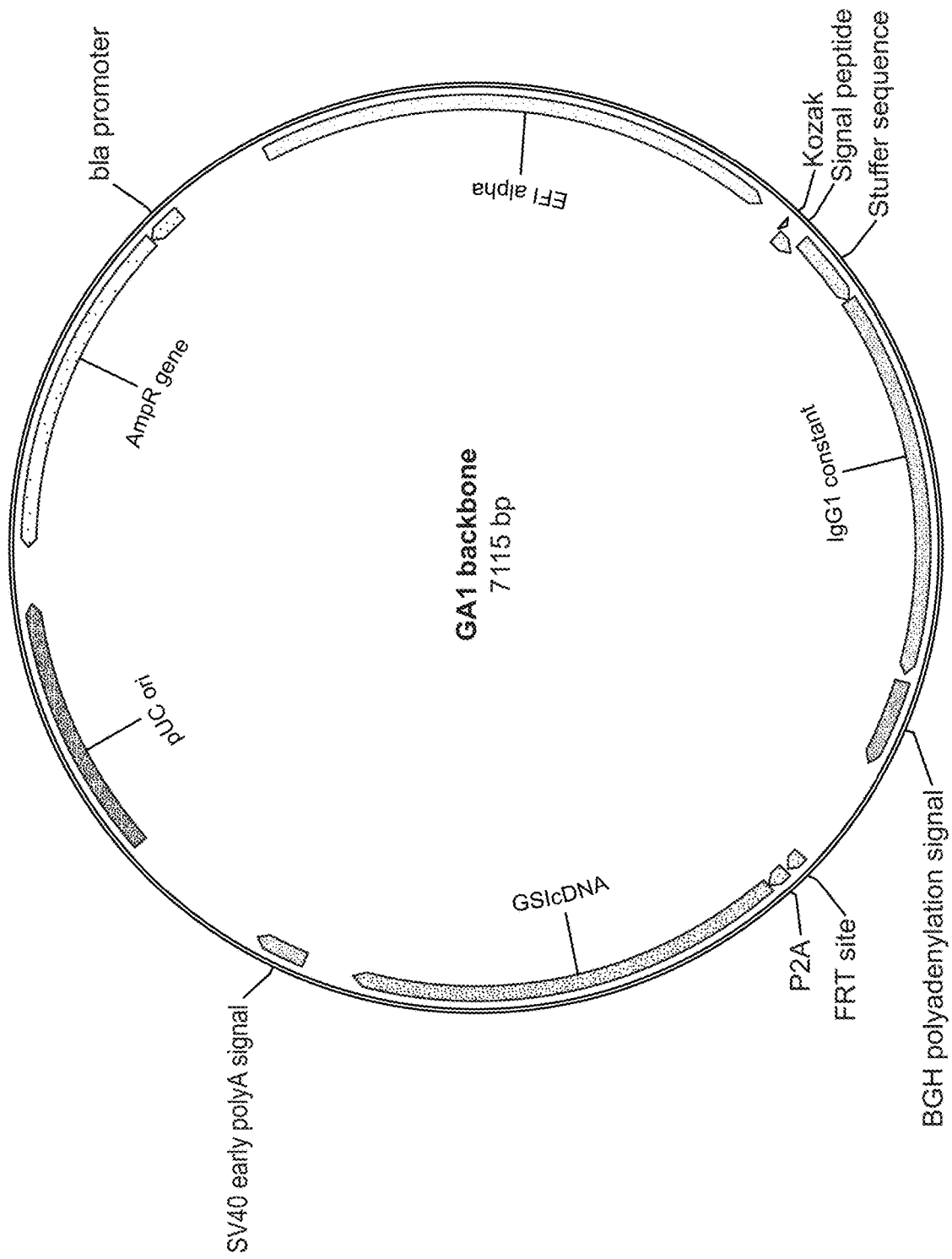

FIG. 13A Gibson Assembly 1 (GA1) backbone (GenBank accession MW079271).

Figure 13B:
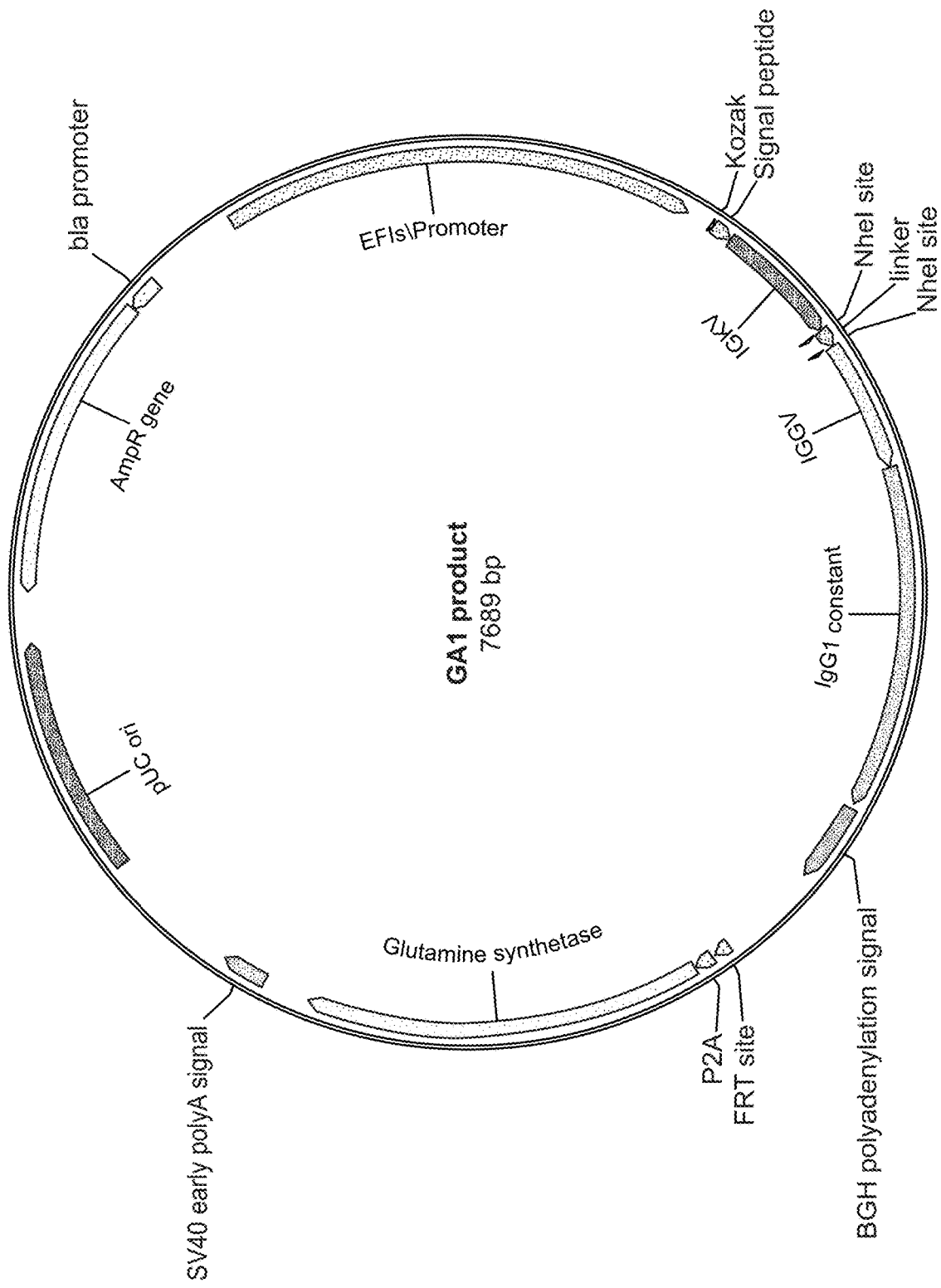

FIG. 13B Product of Gibson Assembly 1 (GA1) after insertion of an scFv sequence (GenBank accession MW079272).

Figure 13C:
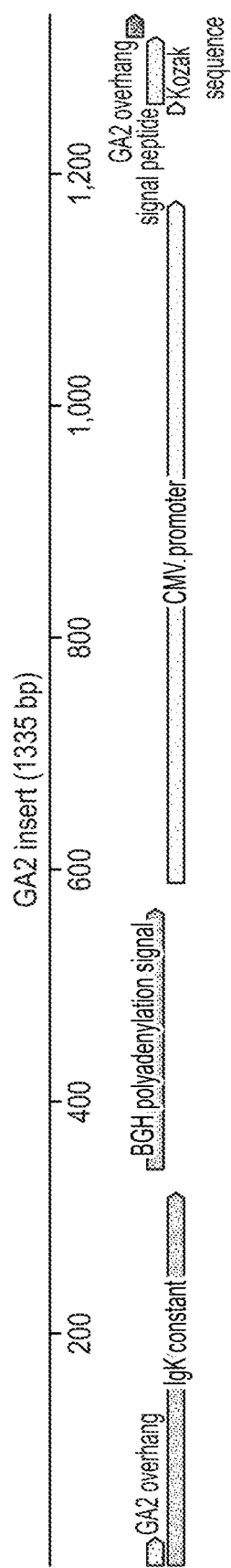

FIG. 13C The linear Gibson Assembly 2 (GA2) insert sequence (GenBank accession MW079275).

Figure 13D:
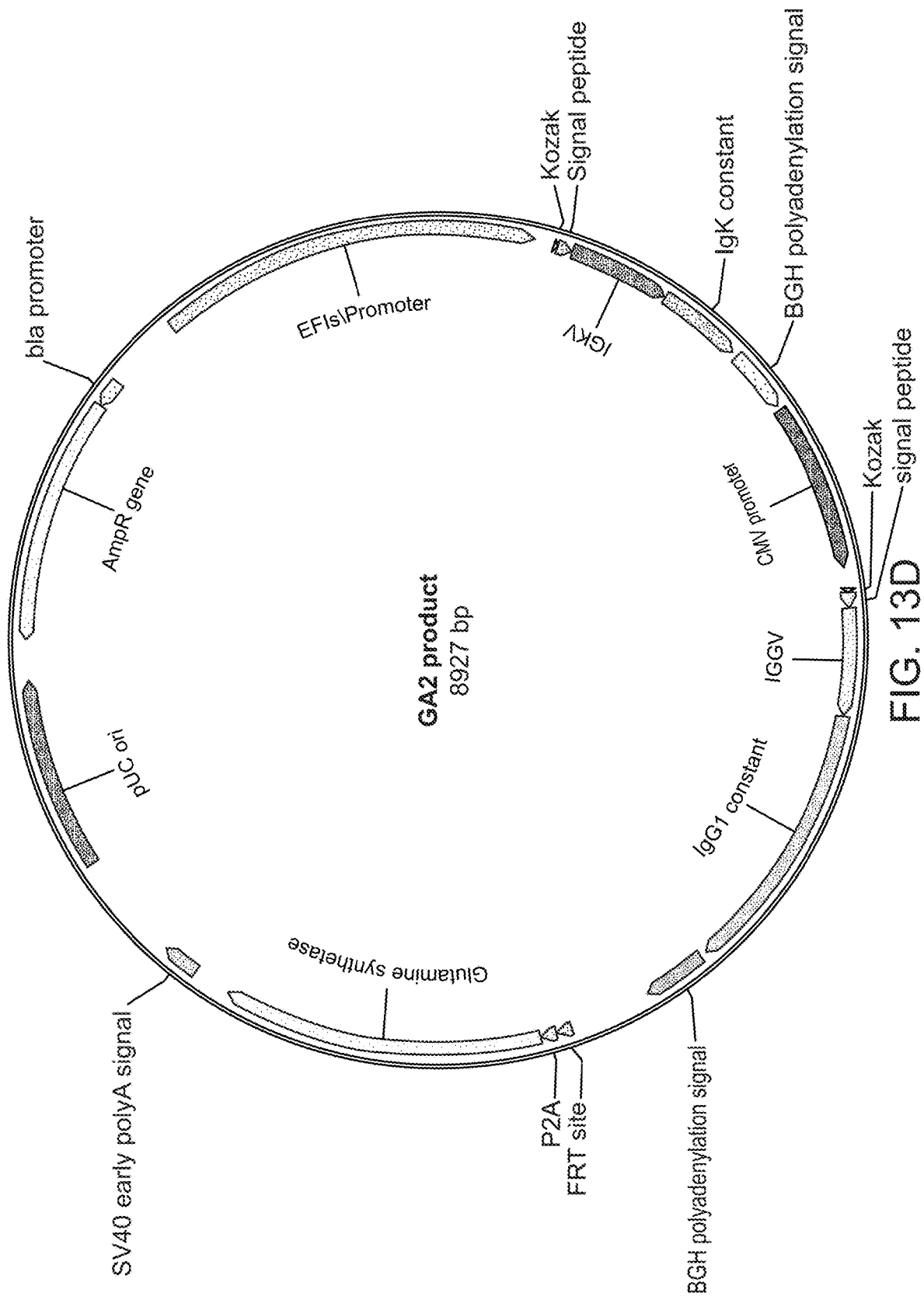

FIG. 13D Product of Gibson Assembly 2 (GA2) after insertion of the GA2 insert (GenBank accession MW079273).

Figure 13E:
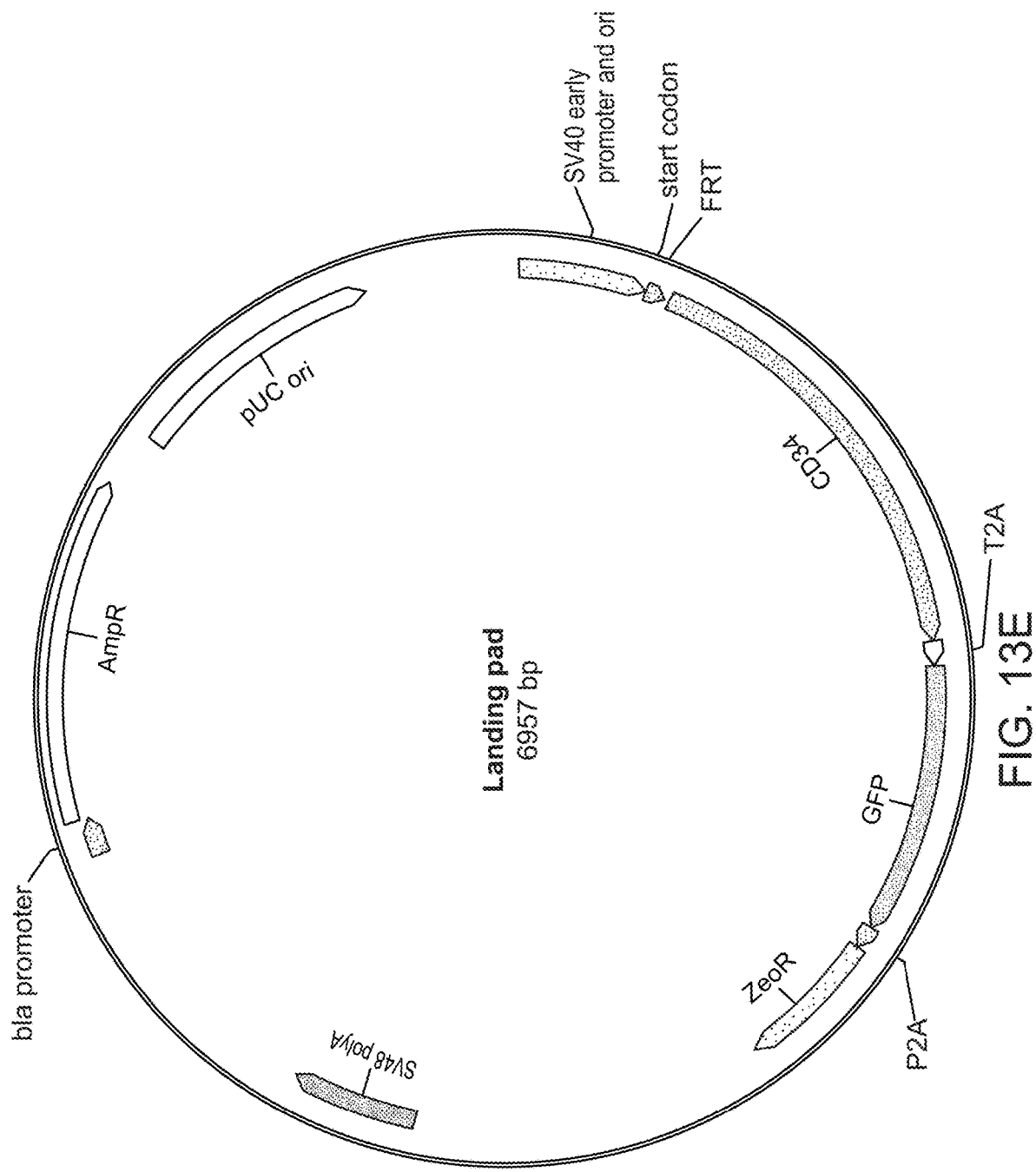

FIG. 13E Landing pad plasmid used to generate a custom CHO landing pad cell line (GenBank accession MW079274).

Figure 14A:
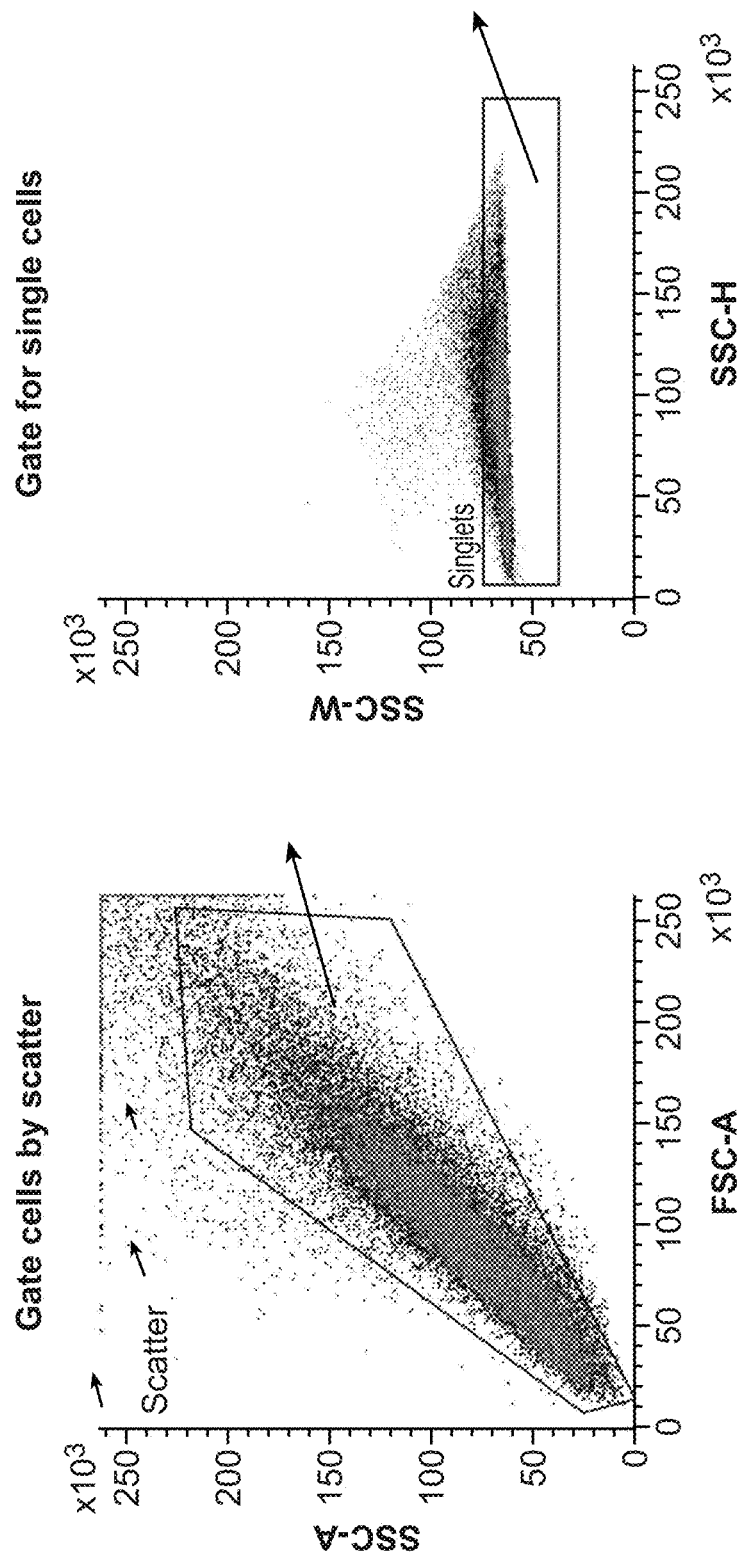
Figure 14A:
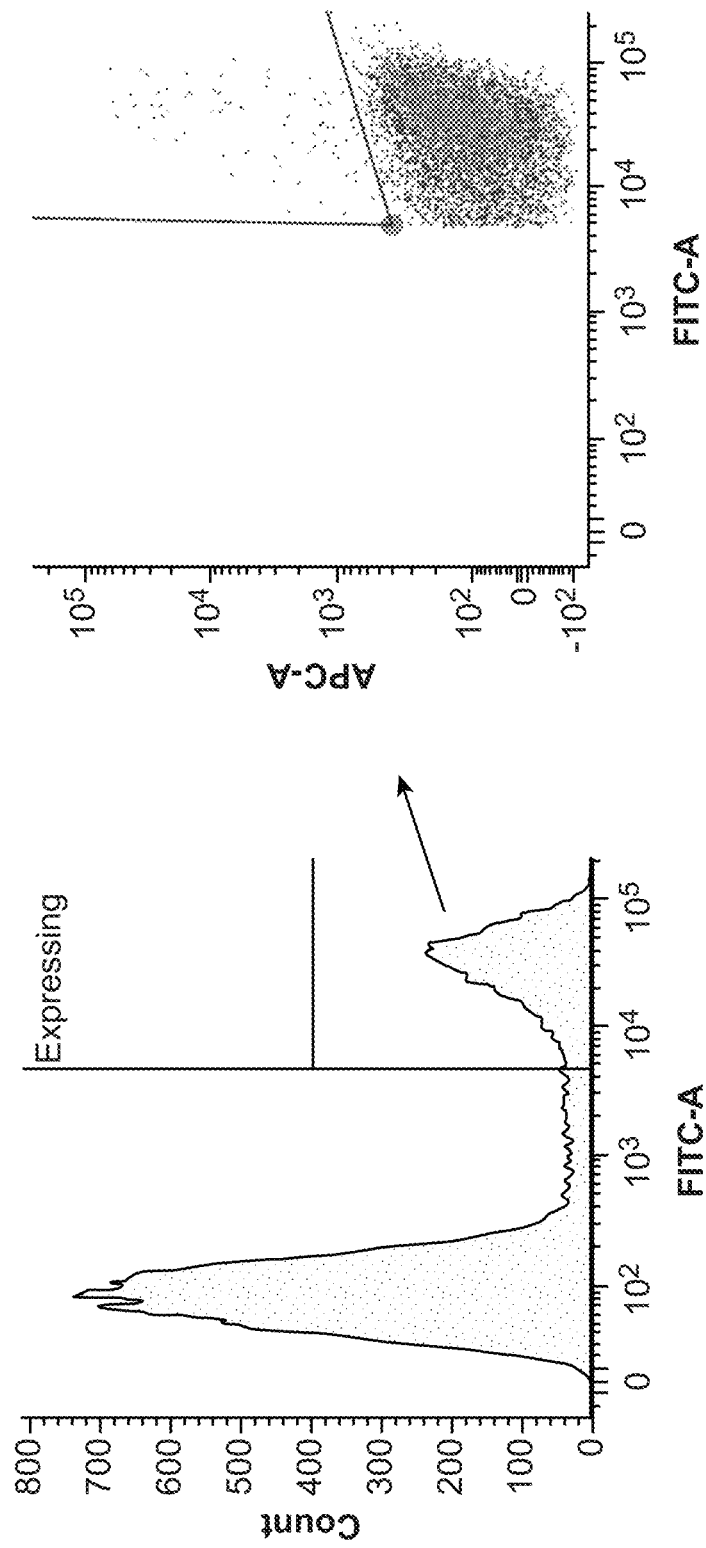

FIG. 14A shows flow sorting for SARS-CoV-2 specific antibodies using yeast scFv display. Gating strategy was used for each yeast sort.

Figure 14B:
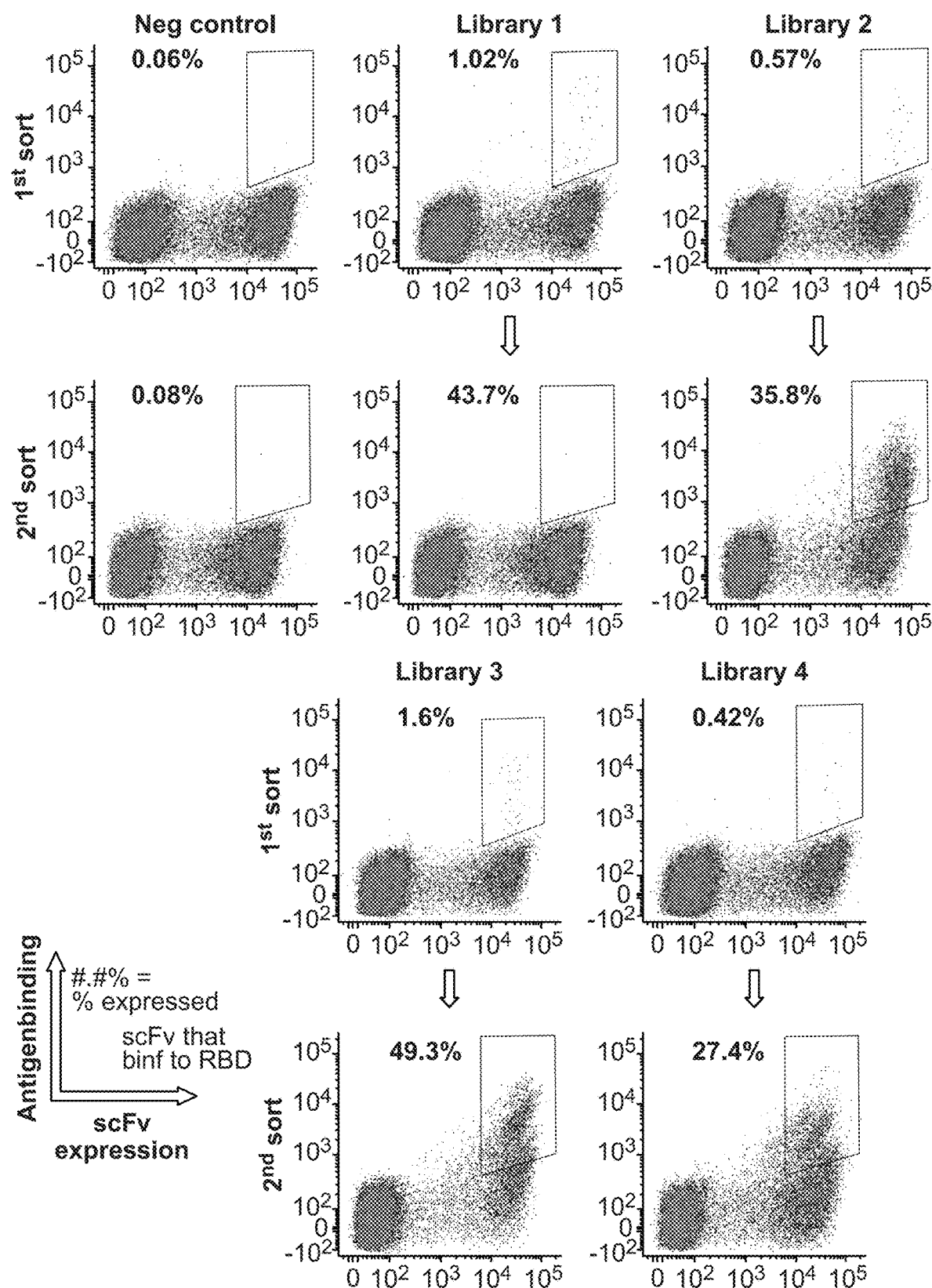
Figure 14B:
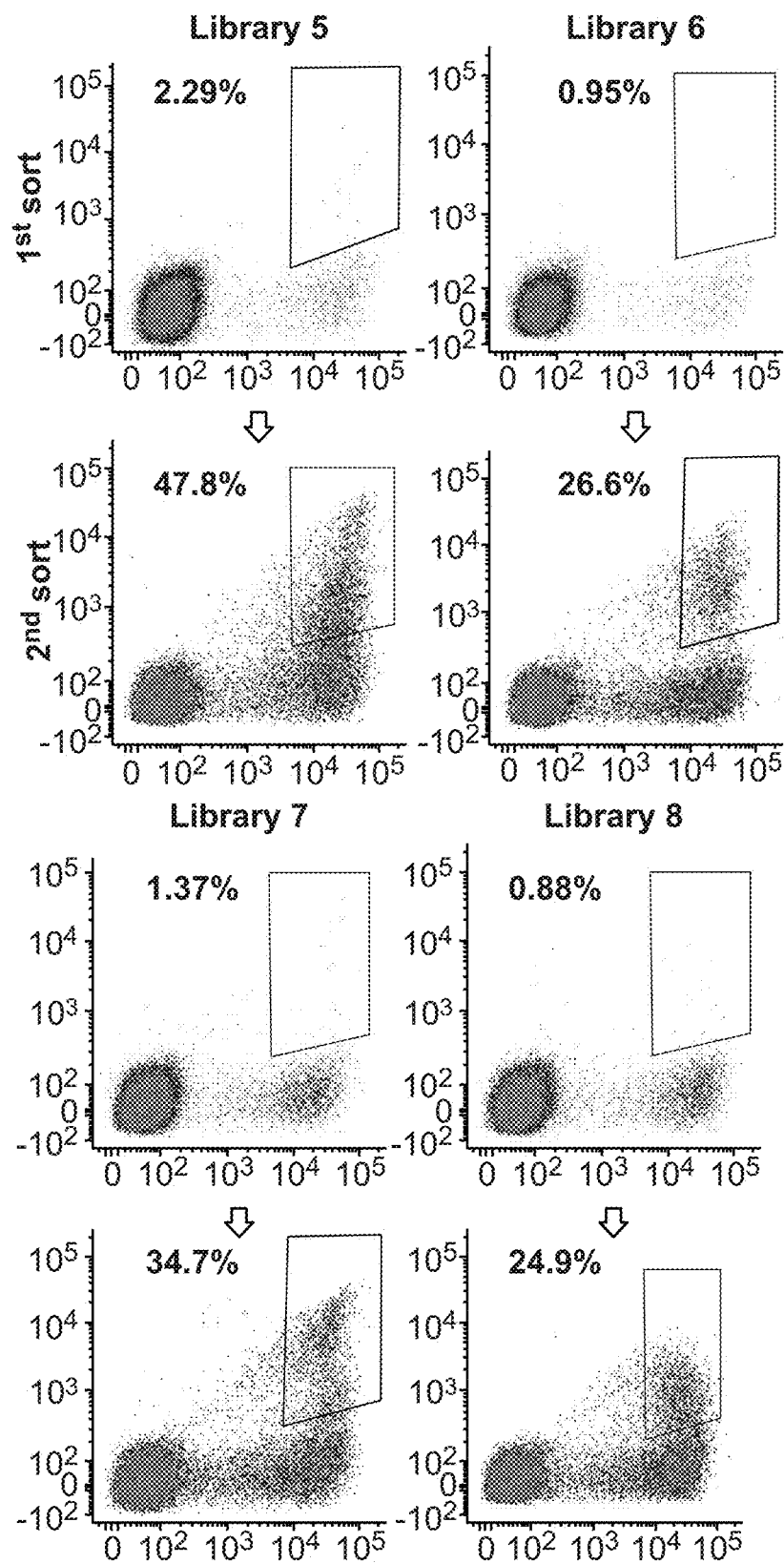

FIG. 14B shows detection of a C-terminal c-Myc tag (x-axis), indicating expression of an scFv on the surface of the cell. The y-axis measures binding of antigen to the scFv-expressing cells. The gates used for yeast selection (double positive) are indicated, with the percentage of scFv-expressed RBD binders. A negative control and the eight rCIG convalescent donor libraries were stained with 1200 nM biotinylated CoV-2 RBDHis. An average of 1.1% of the expressed antibodies were RBD-specific on the first sort. After the second sort, the RBD-specific scFv were amplified and then cloned into full-length antibody expression plasmids.

FIG. 15 shows CoV-2 S1- and RBD-specific antibody binding measured by ELISA. rCIG, the 8 recombinant libraries, the 8 plasma pools from donors that made up rCIG, neutralizing SARS-CoV-2 mAb, nonneutralizing SARS-CoV mAb, and IVIG were titrated relative to total IgG concentration.

FIG. 16A illustrates ACE2 inhibition assay. The blocking ability of SARS-CoV-2 specific antibodies were measured using a plate-based ELISA method. Spike RBD was used to coat the plate and after the antibody samples are coincubated, ACE2 was added and measured for binding to RBD; antibodies that block the interaction demonstrate low or no binding of ACE2 and are considered neutralizing.

FIG. 16B shows results from the ACE2 inhibition assay. The recombinant polyclonal rCIG, the 8 recombinant antibody libraries, the 8 plasma pools from donors that make up rCIG, neutralizing SARS-CoV-2 mAb, non-neutralizing SARS-CoV mAb, and IVIG were titrated and added to the RBD coated plate. The data are reported as "% no Ab control", i.e., dividing the signal of the test article by the signal of a no Ab control.

FIG. 17A illustrates CoV-2 pseudotype virus neutralization assay. A pseudotype virus expressing the SARS-CoV-2 spike proteins can infect ACE2-expressing target cells (which then turn green due to GFP expression from the pseudotype virus), which is used to demonstrate whether antibodies specific to SARS-CoV-2 can neutralize infection.

FIG. 17B shows results from the CoV-2 pseudotype virus neutralization assay. The recombinant polyclonal rCIG, the 8 recombinant antibody libraries, the eight plasma pools from donors that make up rCIG, neutralizing SARS-CoV-2 mAb, non-neutralizing SARS-CoV mAb, and IVIG were titrated and added to ACE2-expressing cells in the presence of CoV-2 pseudotype virus. The percent of infected cells (GFP+) was quantified by flow cytometry and was normalized by dividing by the GFP+ signal in the negative control wells, which lacked test article.

Figure 17C:
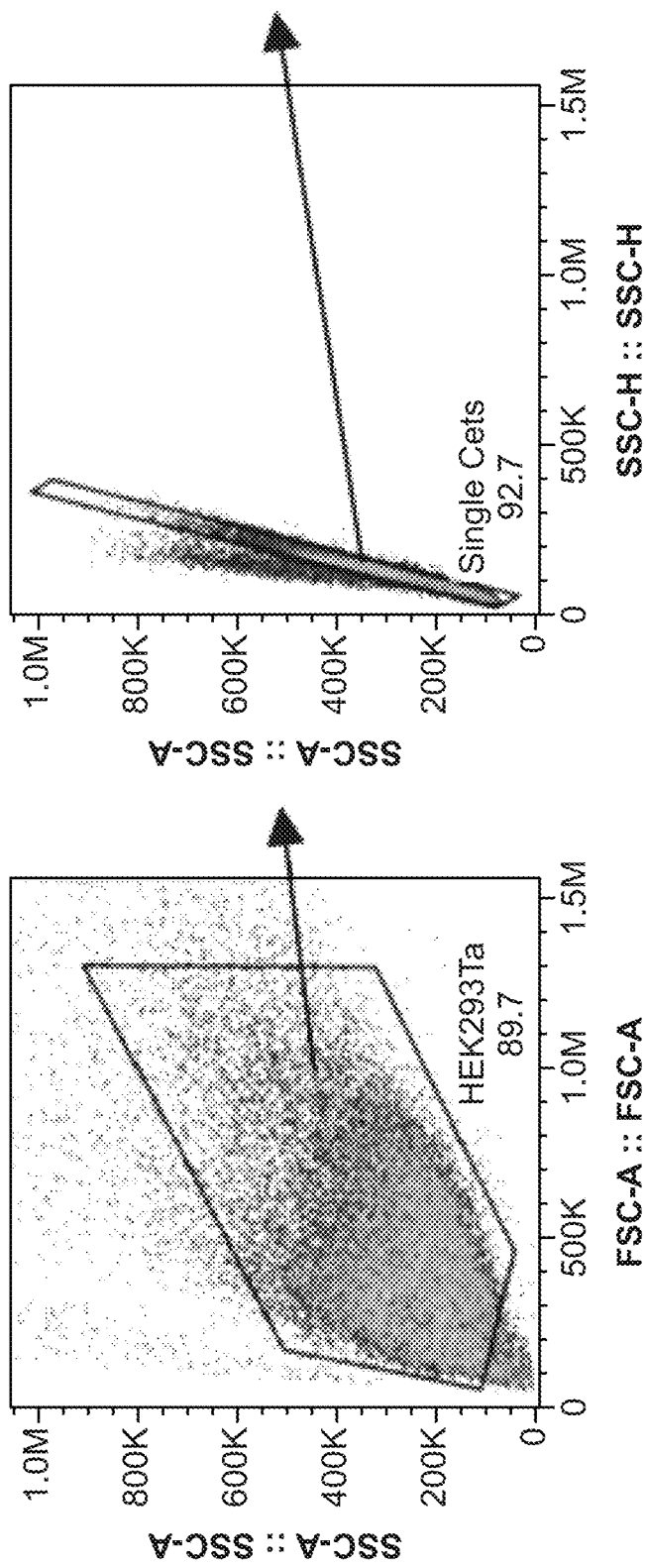
Figure 17C:
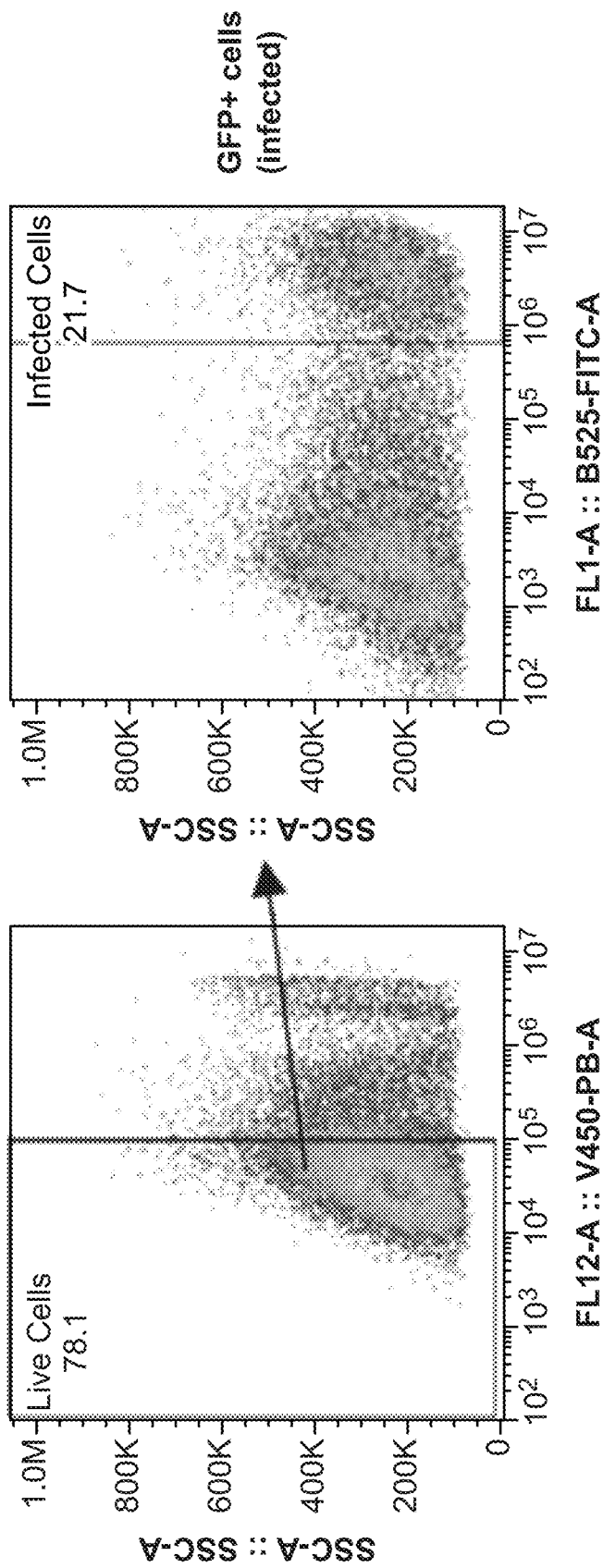
Figure 19B:
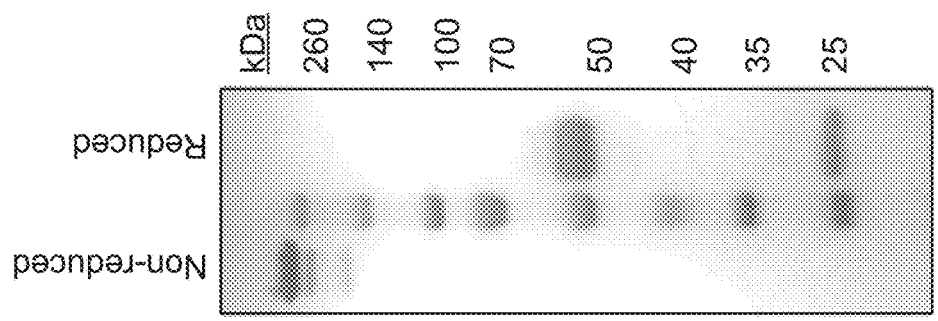
Figure 19A:
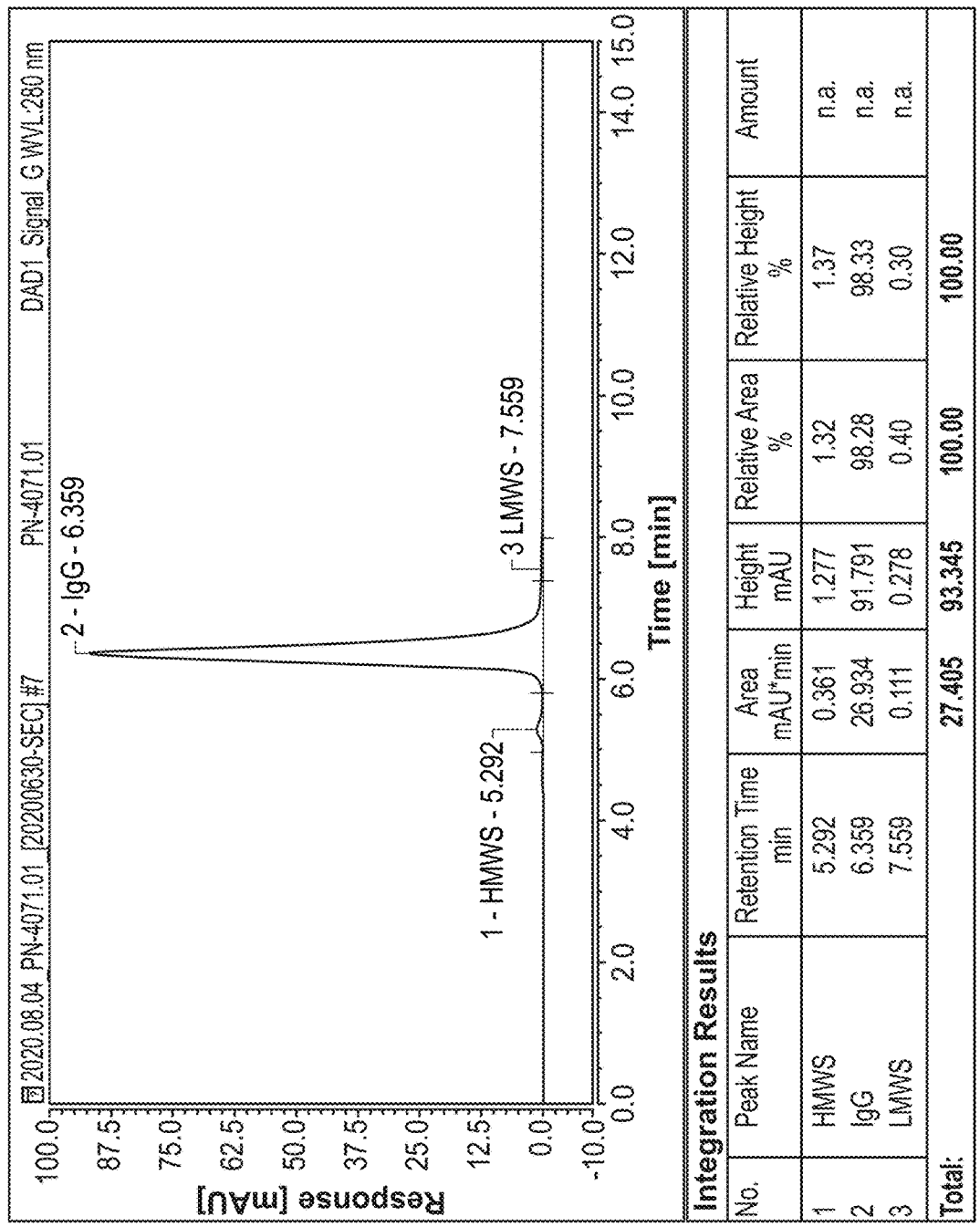
Figure 19C:
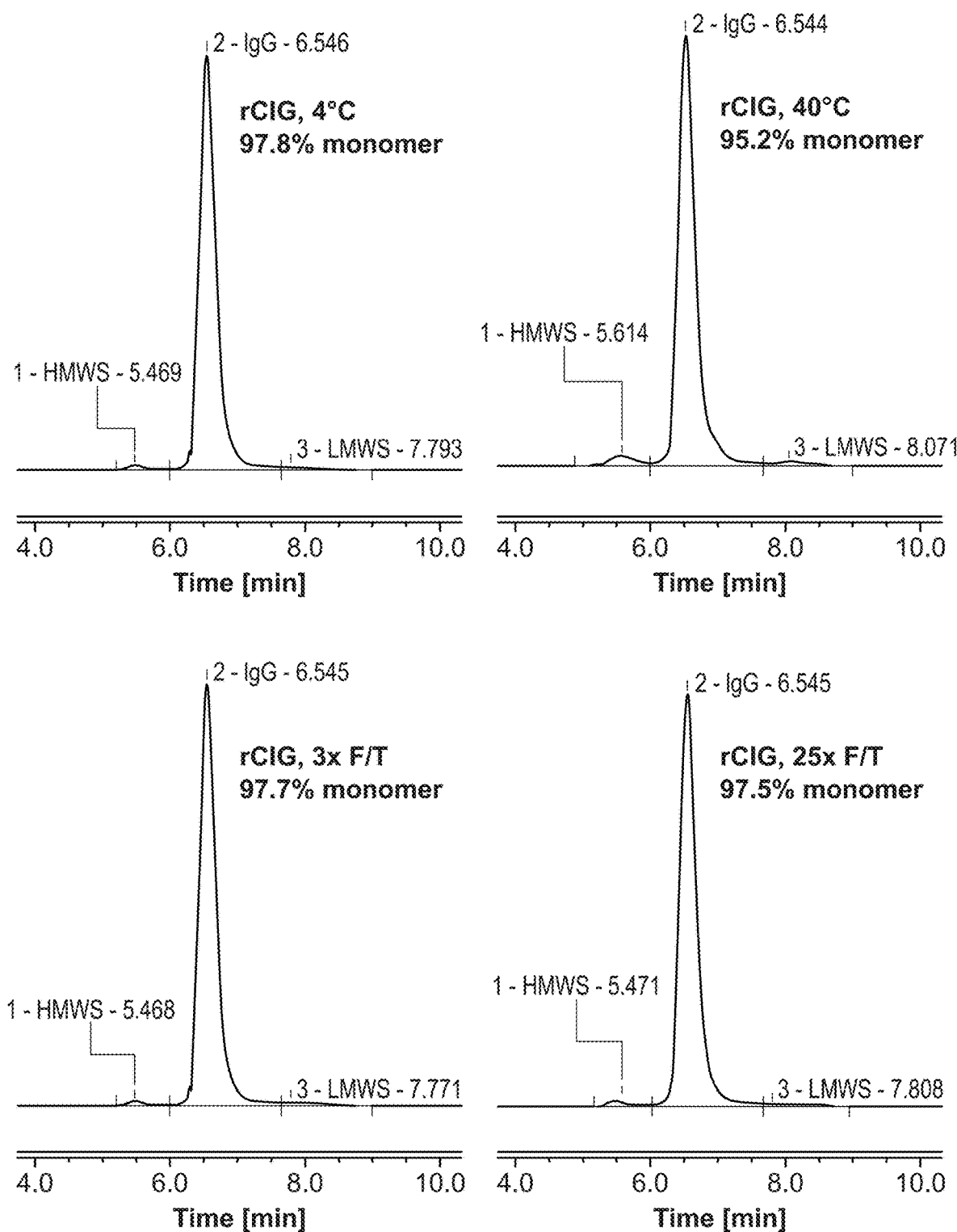
Figure 19D:
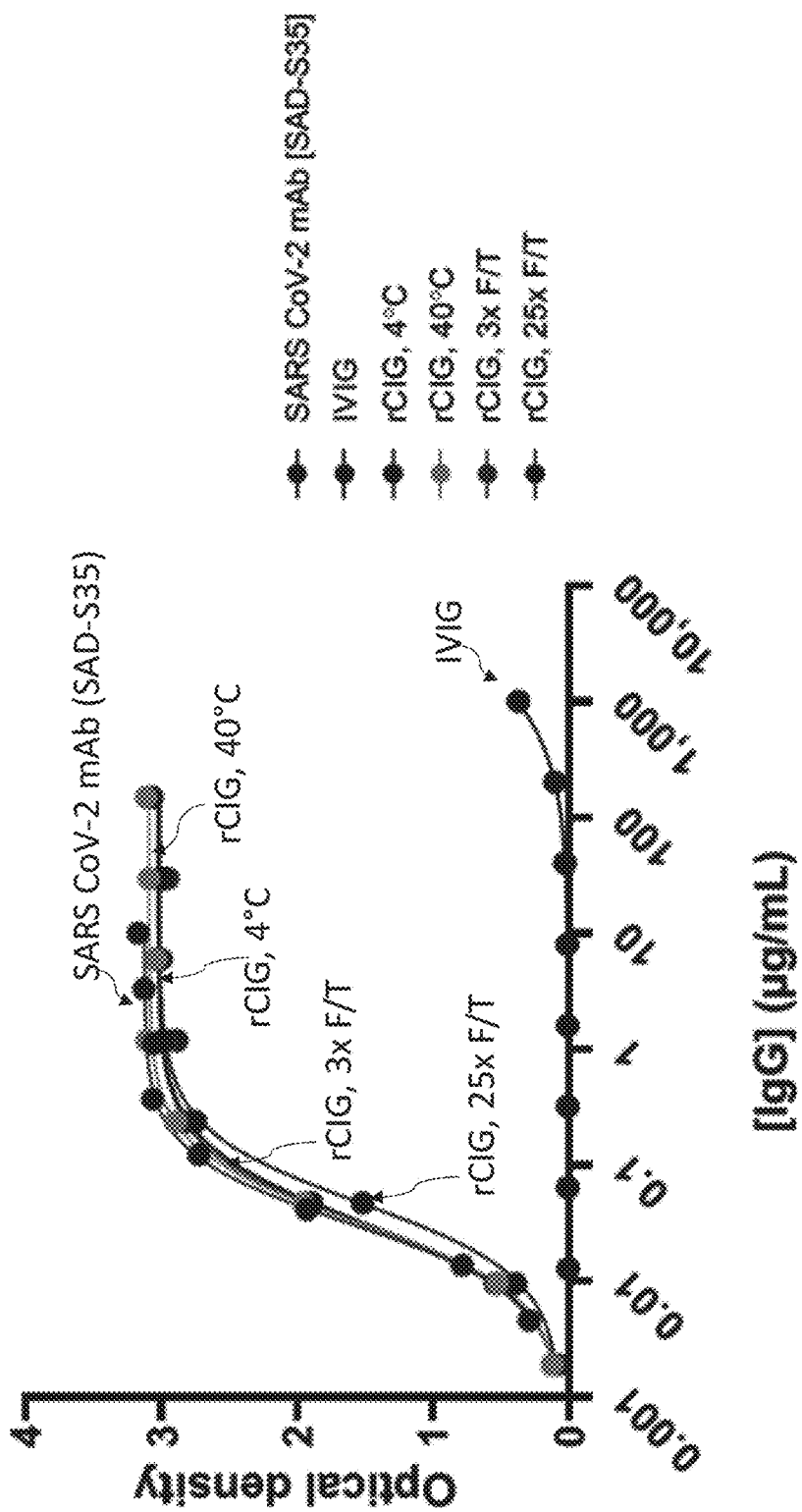

FIG. 17C provides flow gating strategy of the pseudotype virus neutralization assay to identify live, GFP+ cells (those infected with pseudotype virus).

FIGS. 18A and 18B show quality control analysis of purified rCIG protein. (FIG. 18A) SEC-HPLC analysis used to assess the purity of the Protein A-purified protein. (FIG. 18B) SDS-PAGE analysis used to assess the purity of the Protein A-purified protein.

FIG. 19A to 19D show stability, purity and functional assay of polished rCIG protein. (FIG. 19A) SEC-HPLC analysis used to assess the purity of the polished rCIG protein. (FIG. 19B) SDS-PAGE analysis used to assess the purity of the polished rCIG protein. (FIG. 19C) SEC-HPLC ELISA used to assess the purity and function of the rCIG protein after incubation at 4° C. or at 40° C. for 14 days, or after undergoing 3 or 25 freeze-thaw cycles (F/T). 40° C. incubation weakly increased the high molecular weight species with no change in SARS CoV-2 ELISA binding, while 25× F/T had no change in purity but had ~50% reduced binding to SARS CoV-2. (FIG. 19D) SARS-CoV-2 S1 ELISA used to assess the purity and function of the rCIG protein after incubation at 4° C. or at 40° C. for 14 days, or after undergoing 3 or 25 freeze-thaw cycles (F/T). 40° C. incubation weakly increased the high molecular weight species with no change in SARS CoV-2 ELISA binding, while 25× F/T had no change in purity but had ~50% reduced binding to SARS CoV-2.

Figure 20A:
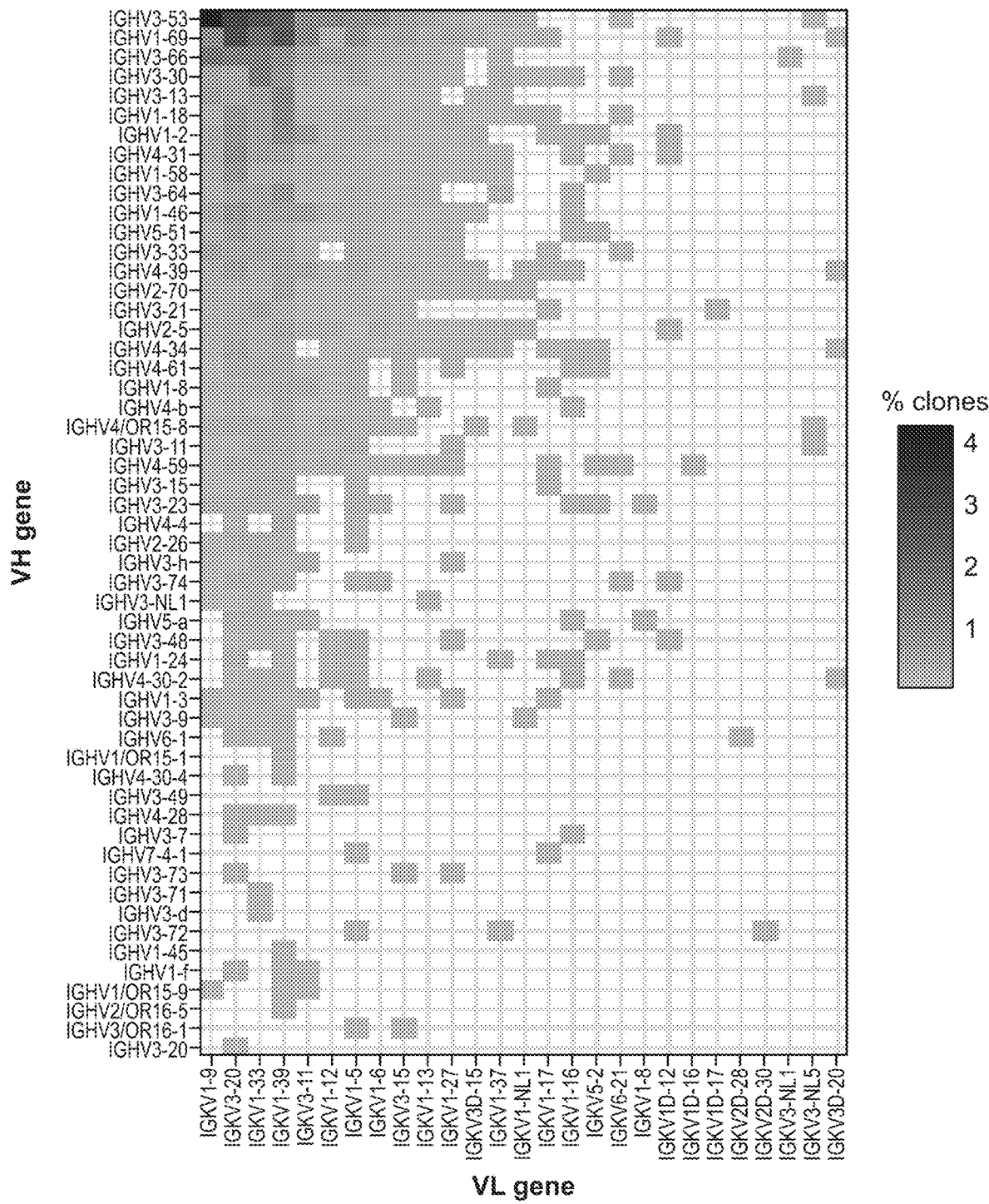

FIG. 20A to 20D show repertoire sequencing analysis of rCIG. FIG. 20A is a heatmap showing antibody variable (V) gene usage from the linked scFv library (the 8 sorted libraries combined). The x-axis and y-axis show light and heavy chain V genes, respectively. The greyscale represents unique clone abundance in the library.

Figure 20B:
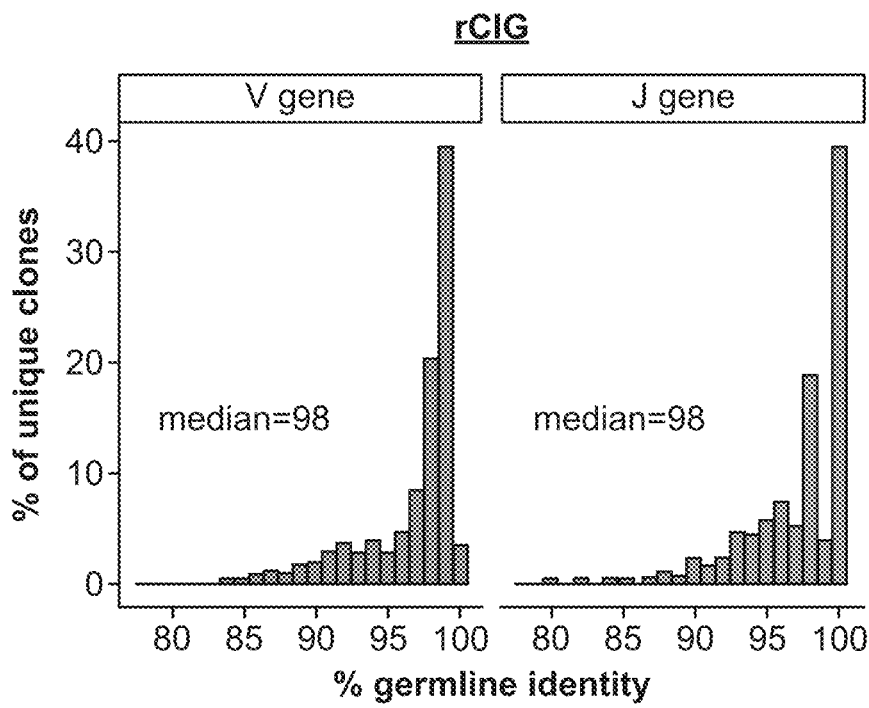

FIG. 20B is a histogram showing distribution of percent germline identity for variable gene (V; left panel) and joining gene (J; right panel), from the final CHO library.

Figure 20C:
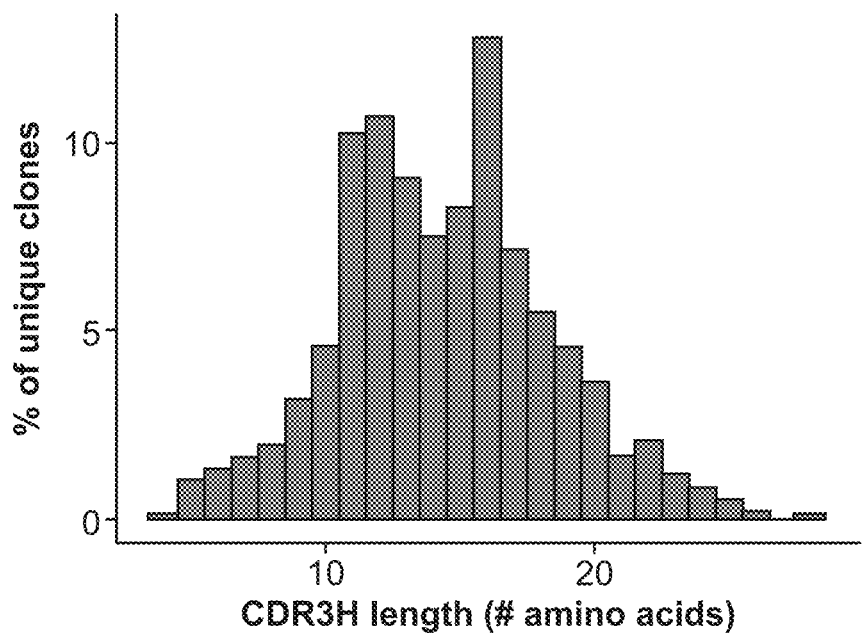

FIG. 20C is a histogram showing the distribution of heavy chain CDR3 amino acid length, from the final CHO library.

Figure 20D:
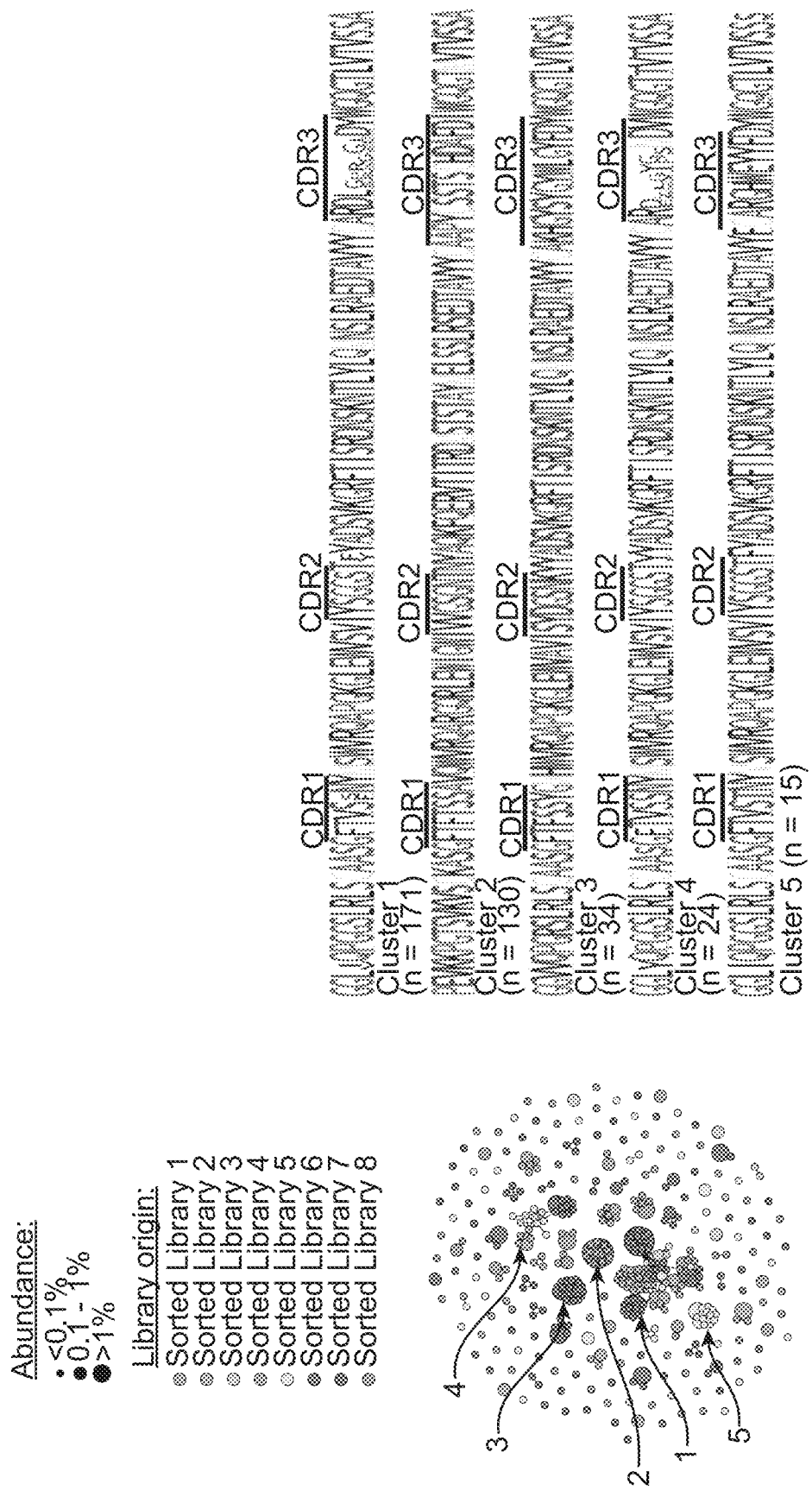

FIG. 20D shows the clonal cluster analysis of rCIG antibodies from FIG. 8C (from the final CHO library) (left). FIG. 20D also shows sequence logos of all heavy chain sequences from the top five clusters (based on clone count). The first 8 amino acids (variable region primer binding sites) are not shown. FIG. 20D discloses SEQ ID NOS: 8410-8414, respectively, in order of appearance.

Figure 21A:
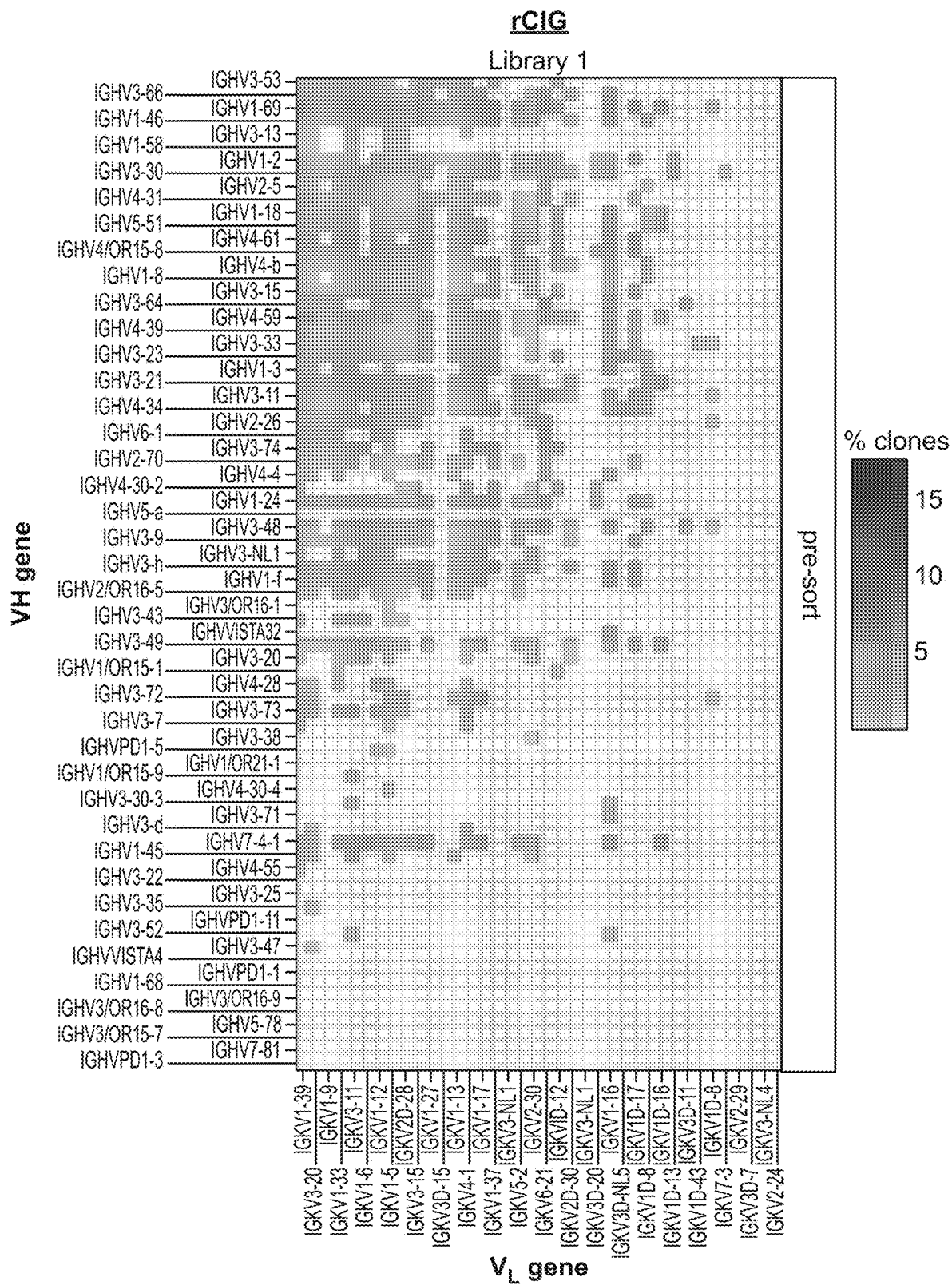
Figure 21B:
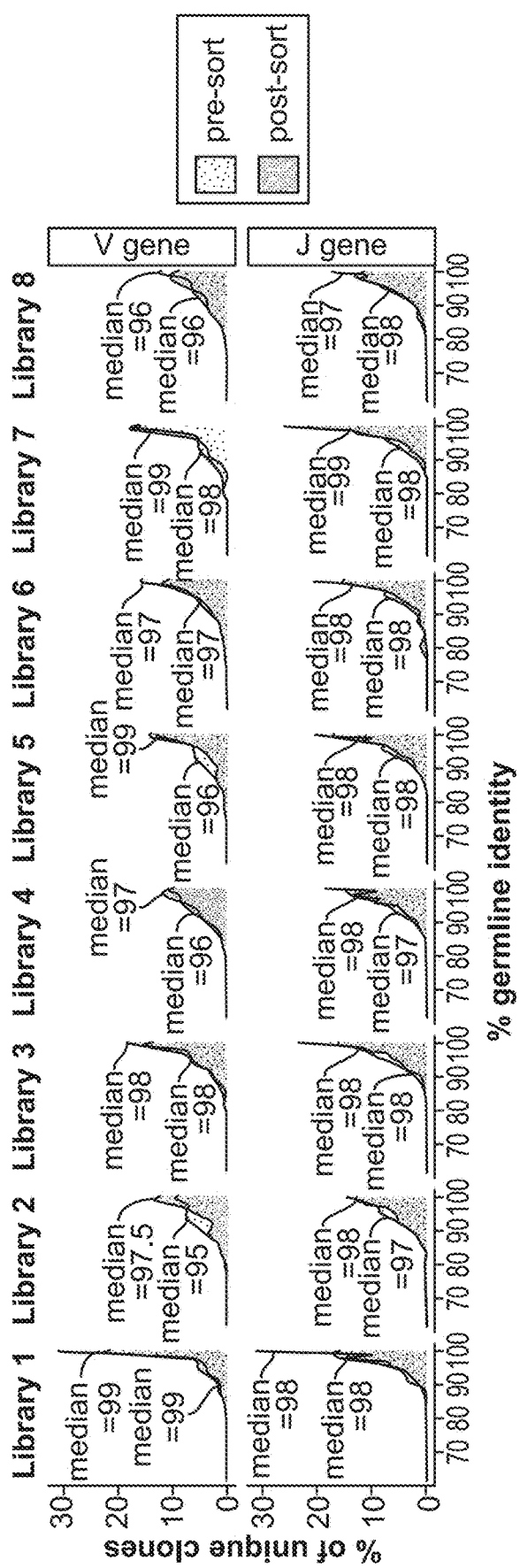
Figure 21C:
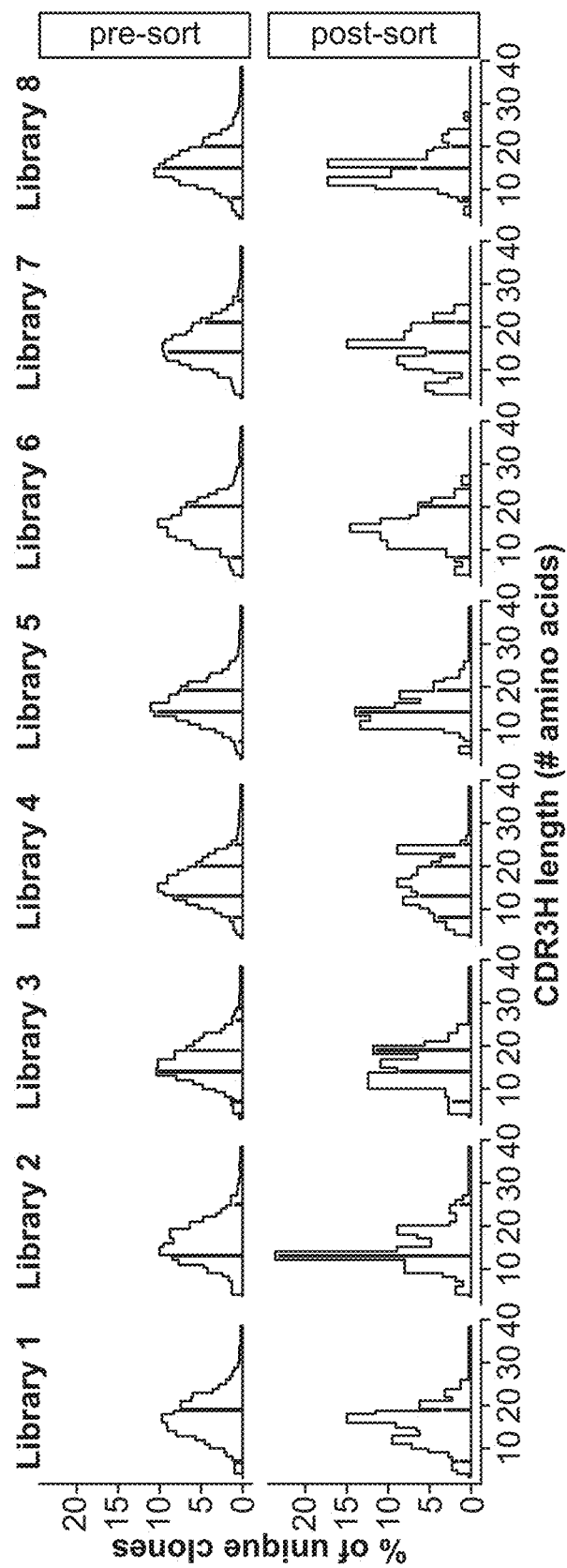

FIG. 21A to 21C shows repertoire sequencing analysis of pre- and post-sort rCIG.

FIG. 21A is a heatmap showing antibody variable (V) gene usage from each pre-sort and post-sort linked scFv library. FIG. 21B is a histogram showing distribution of percent germline identity for variable gene (V; left panel) and joining gene (J; right panel) from each pre-sort and post-sort scFv library. FIG. 21C is a histogram showing the distribution of heavy chain CDR3 amino acid length from each pre-sort and post-sort scFv library.

FIG. 22 shows antibody reactivity to SARS-CoV-2 variants and other coronaviruses. ELISA plates were coated with 2 μg/mL of spike or RBD proteins from known circulating variants of SARS-CoV-2, SARS-CoV, MERS, and other human coronaviruses (HCoV). The binding ability of rCIG, SARS-CoV-2 neutralizing mAb (SAD-S35), and IVIG was determined for each antigen. *, No binding was observed against IVIG, and positive control Zika/Dengue positive serum were serially diluted and added to a Dengue serotypes 1, 2, 3, or 4 envelope-coated plates. Antigen-specific responses were quantified by an anti-human-HRP secondary antibody.

Figure 30:
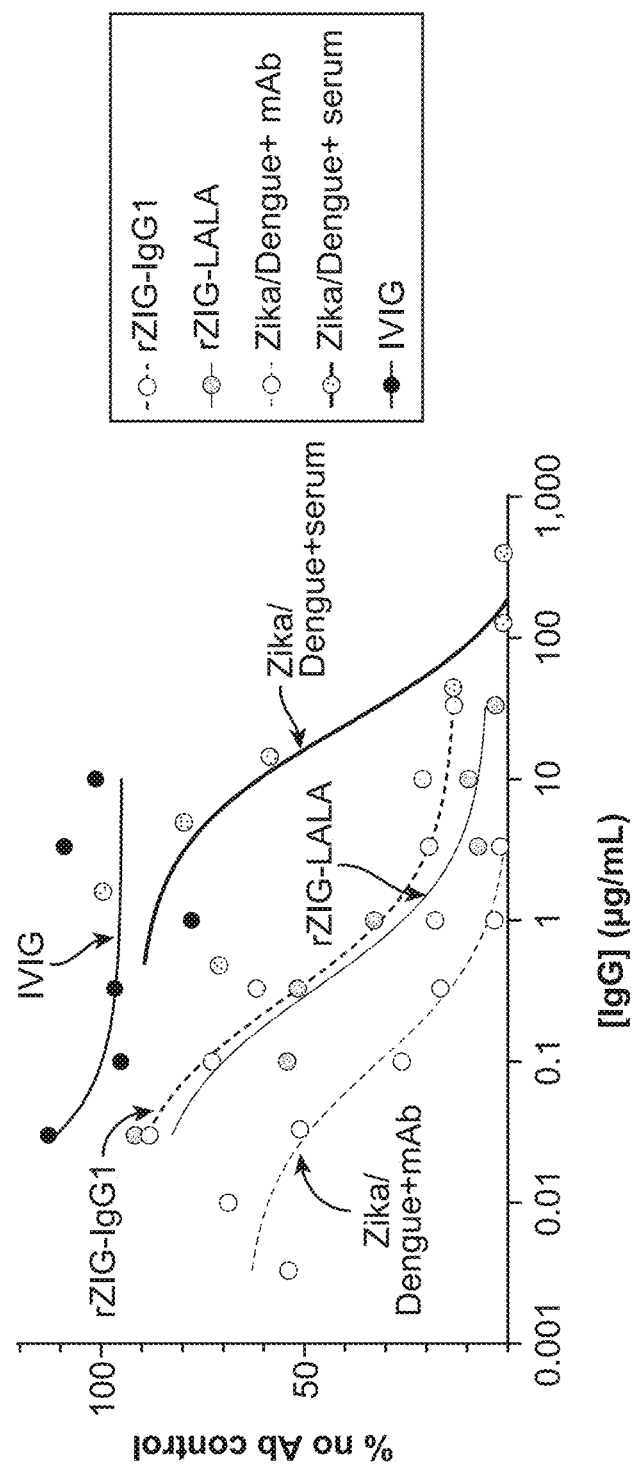

FIG. 30 provides results from Zika pseudotype virus neutralization assay. rZIG-IgG1, rZIG-LALA, negative control IVIG, positive control Zika/Dengue mAb, and positive control Zika/Dengue positive serum were serially diluted, co-incubated with Zika pseudotype virus, and added to BHK/DC-SIGN target cells. Antibody induced neutralization was quantified by the infection-induced luciferase expression divided by luciferase expression in the no Ab control.

Figure 31:
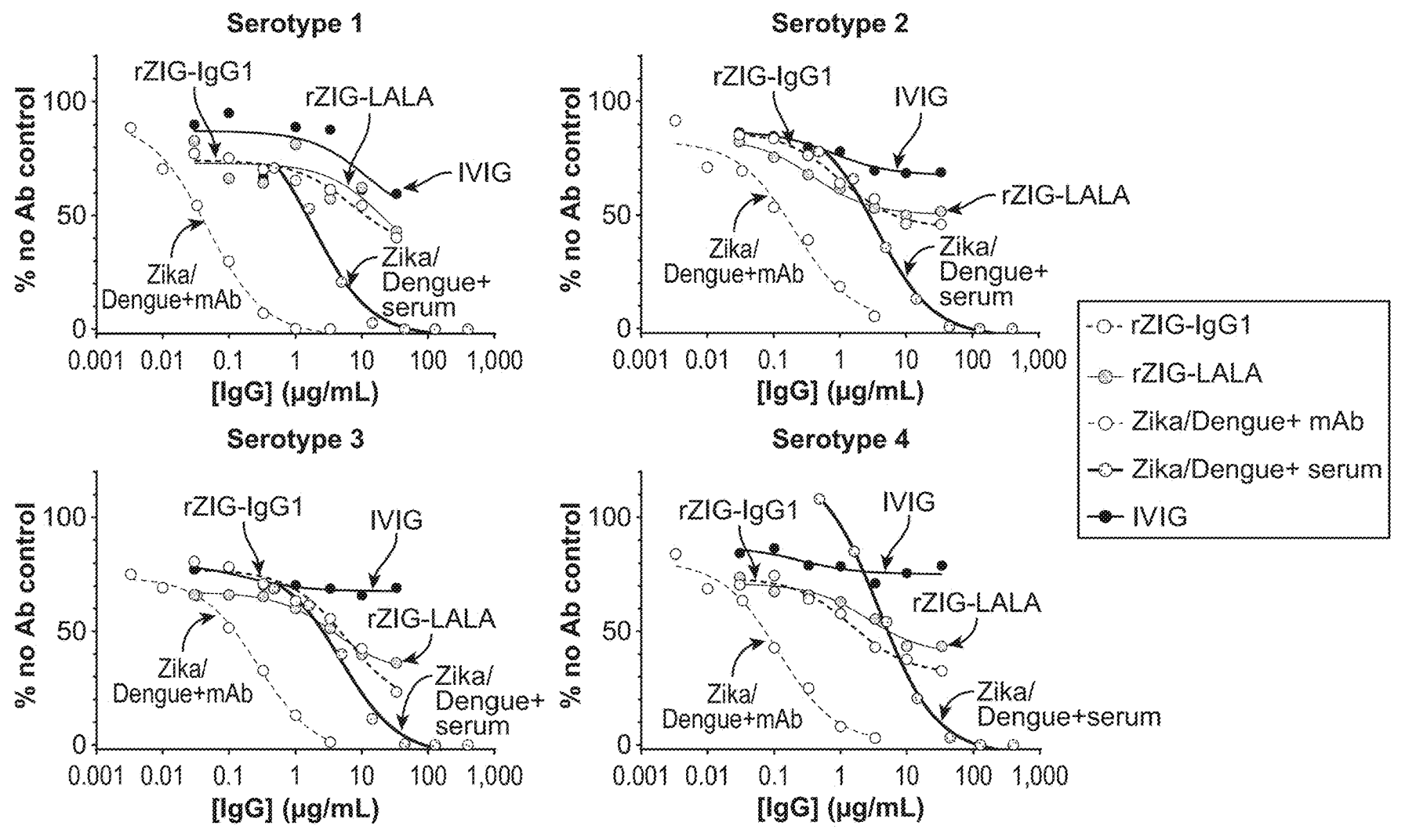

FIG. 31 provides results from Dengue serotype pseudotype virus neutralization assay. rZIG-IgG1, rZIG-LALA, negative control IVIG, positive control Zika/Dengue mAb, and positive control Zika/Dengue positive serum were serially diluted, co-incubated with pseudotype virus expressing the indicated Dengue serotype envelope antigens, and added to BHK/DC-SIGN target cells. Antibody induced neutralization was quantified as "% no Ab control", or infection-induced luciferase expression divided by the luciferase expression in the no Ab control.

FIG. 32 is a schematic of antibody dependent enhancement (ADE) assay. Antibody bound to pseudotype virus can infect cells through the Fc receptor expressed on target cells. By introducing an Fc mutation that prevents FcR binding (e.g. LALA), antibody-induced viral infection is abrogated.

Figure 33A:
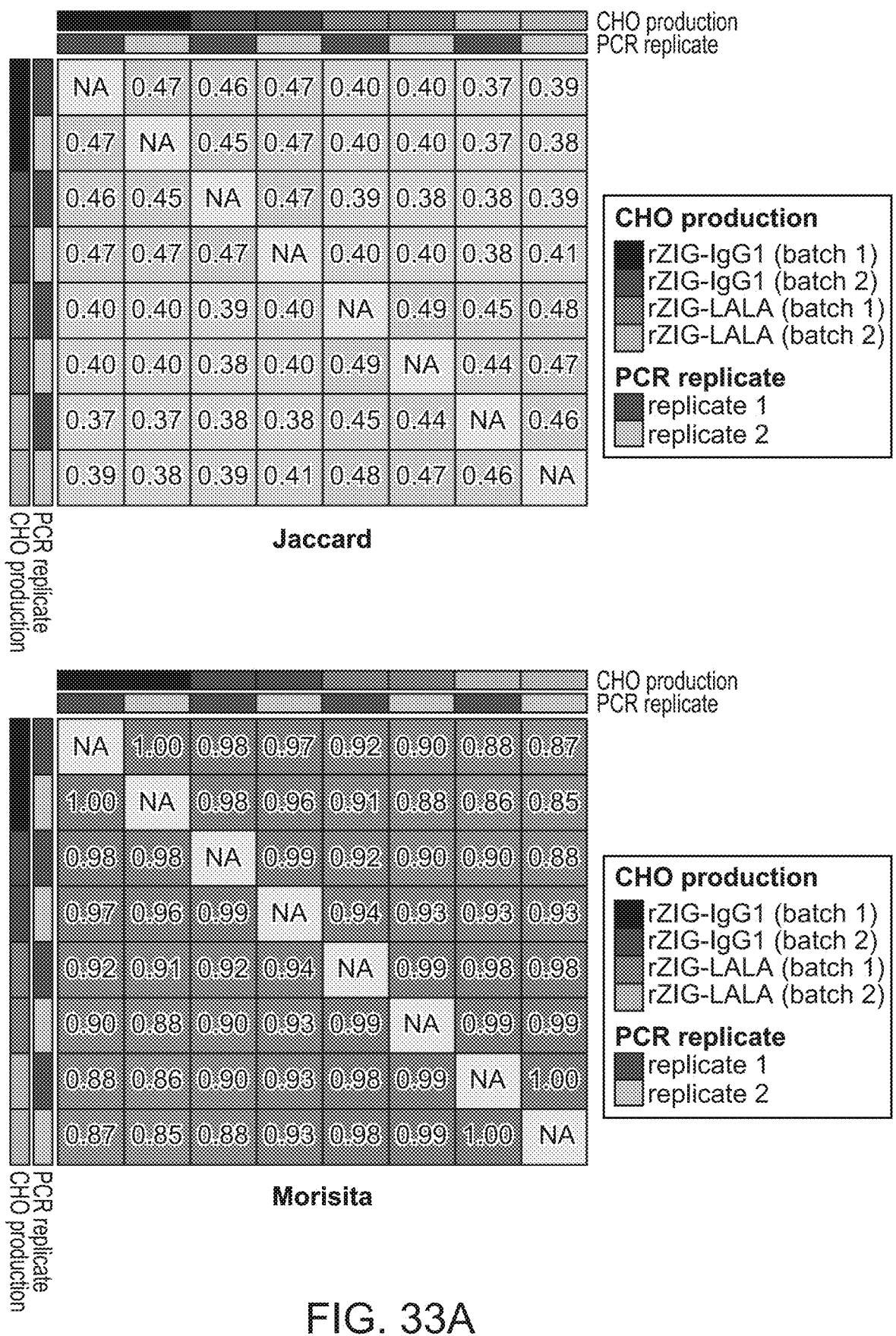
Figure 33B:
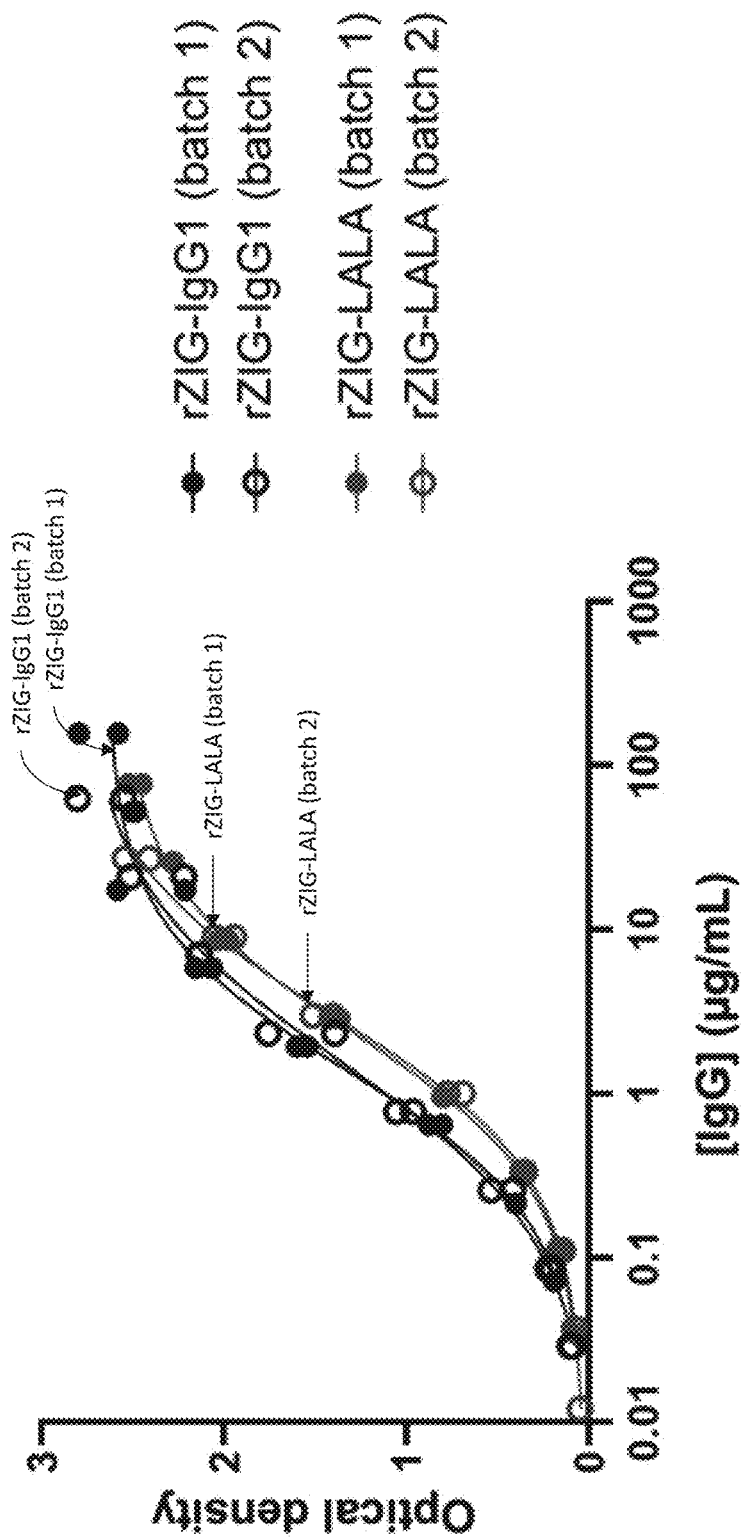

FIGS. 33A and 33B show batch-to-batch variation of rZIG.

FIG. 33A is based on RNA antibody sequencing performed (in duplicate) on RNA isolated from the end of replicate CHO bioreactor production runs. Jaccard (left) and Morisita (right) analyses showed that the amount of antibody clone variation between production batches and between PCR replicates performed on each batch. Wilcoxon rank sum tests showed that the indices from the PCR replicates came from the same population as the indices from the batch replicates, suggesting that the variability inherent to the batches was no worse than the variability between PCR replicates.

FIG. 33B shows binding of the indicated batch of serially diluted rZIG-IgG1 and rZIGLALA to a Zika envelope-coated plate was measured by ELISA.

FIG. 34A to 34D shows results from repertoire sequencing analysis of rHIG.

Figure 34A:
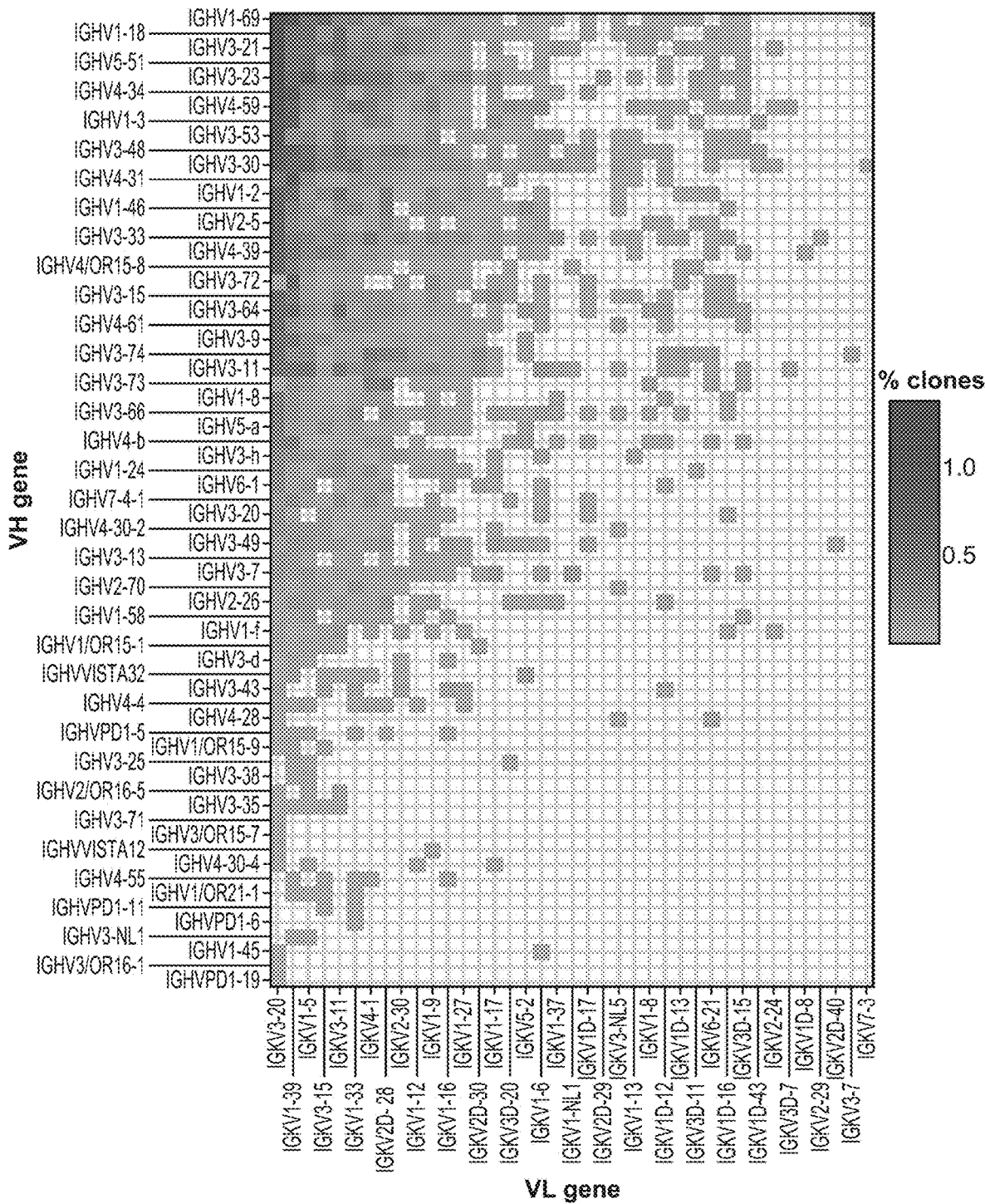

FIG. 34A is a heatmap showing antibody variable (V) gene usage from the linked scFv library. The x-axis and y-axis show light and heavy chain V genes, respectively. The color represents percent unique clone abundance in the library.

Figure 34B:
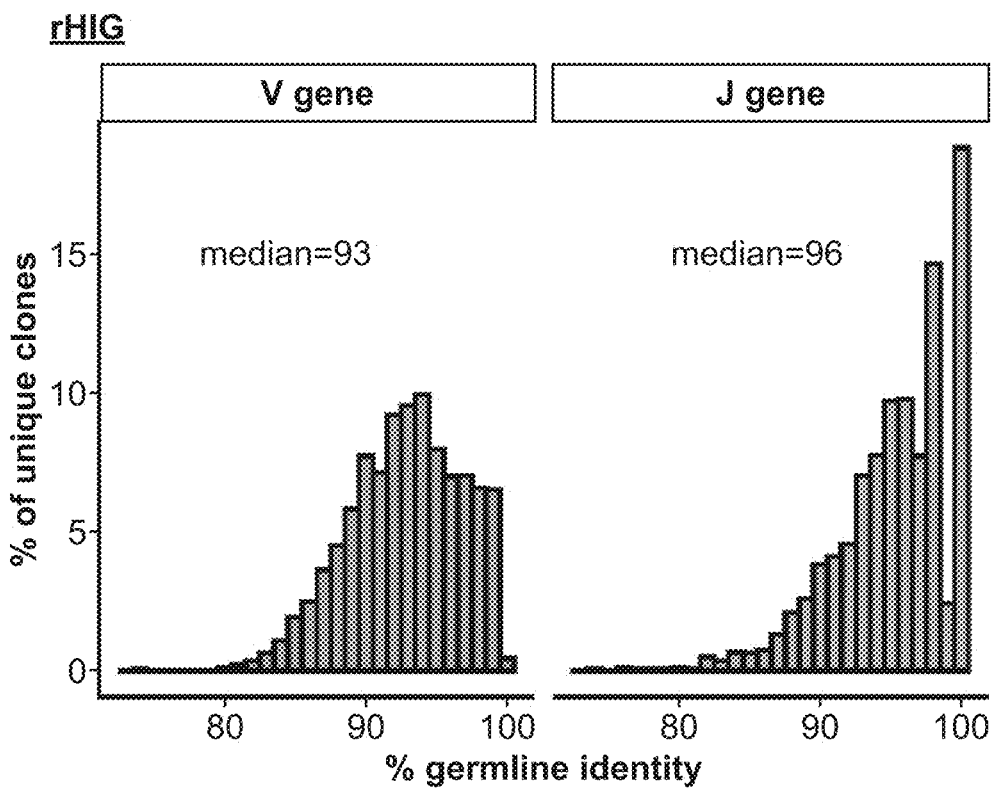

FIG. 34B is a histogram showing distribution of percent germline identity for variable gene (V; left panel) and joining gene (J; right panel), from the final CHO library.

Figure 34C:
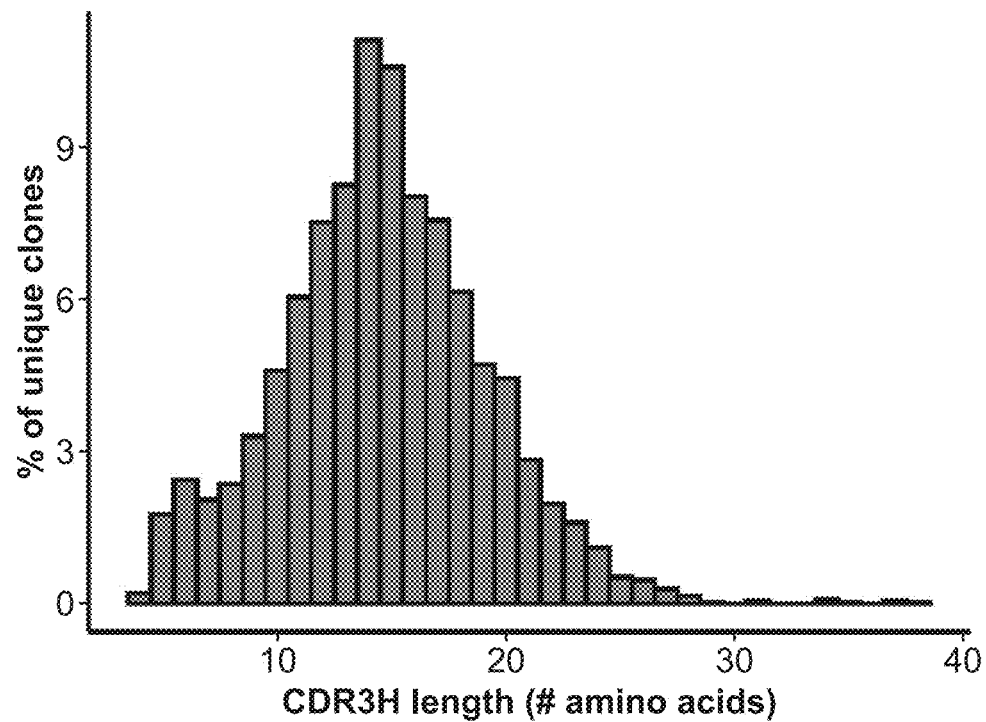

FIG. 34C is a histogram showing the distribution of heavy chain CDR3 amino acid length, from the final CHO library.

Figure 34D:
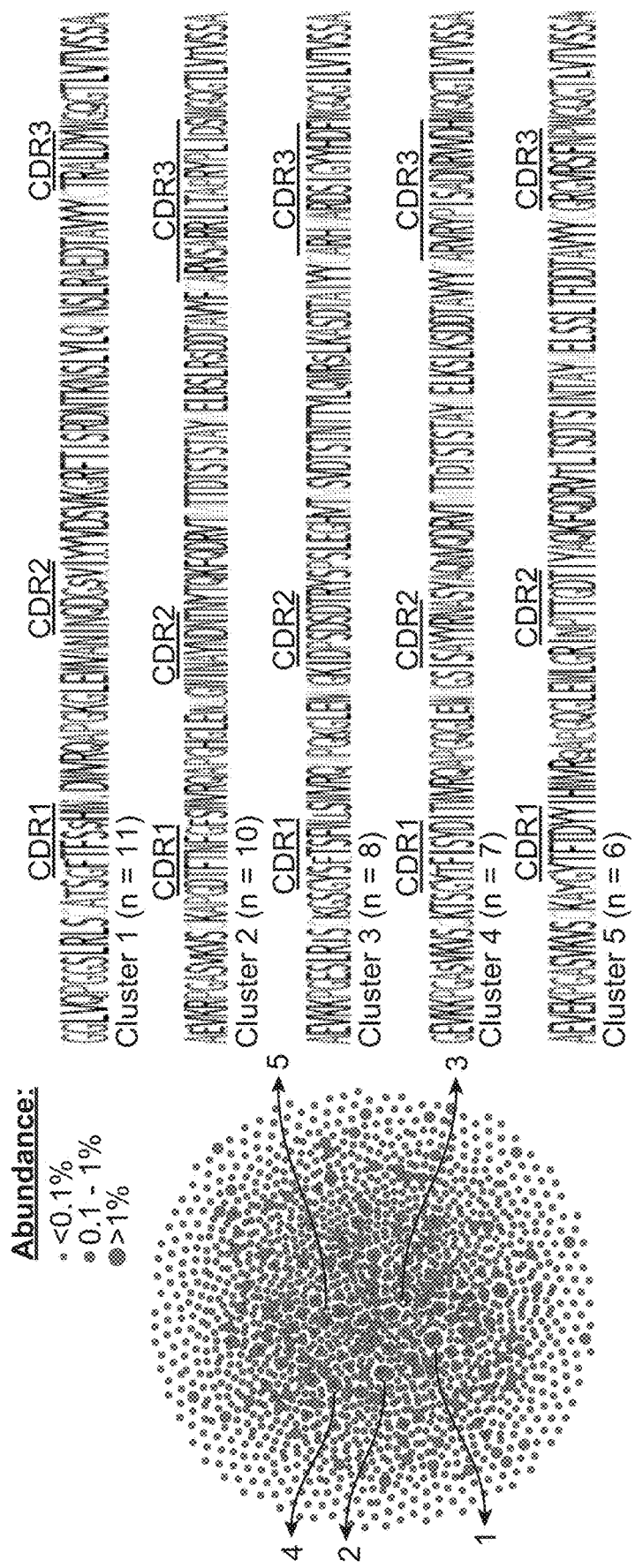

FIG. 34D. Left: The clonal cluster analysis of Rhig antibodies, modified from FIG. 4a (from the final CHO library). Right: Sequence logos of all heavy chain sequences from the top five clusters (based on clone count). The first 8 amino acids (variable region primer binding sites) are not shown. FIG. 34D discloses SEQ ID NOS: 8420-8424, respectively, in order of appearance.

FIG. 35A to 35D provide results from repertoire sequencing analysis of rPIG.

Figure 35A:
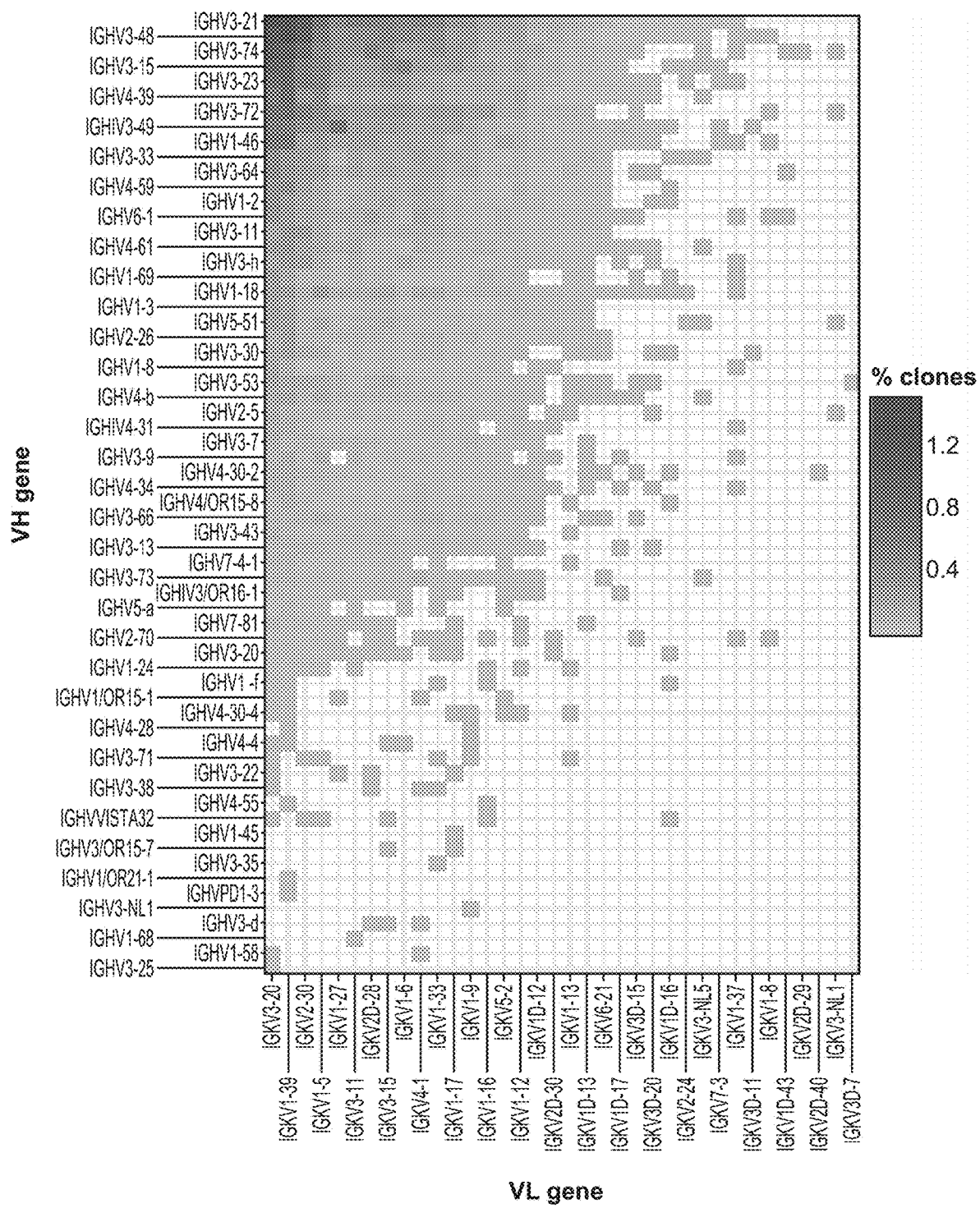

FIG. 35A is a heatmap showing antibody variable (V) gene usage from the linked scFv library. The x-axis and y-axis show light and heavy chain V genes, respectively. The color represents percent unique clone abundance in the library.

Figure 35B:
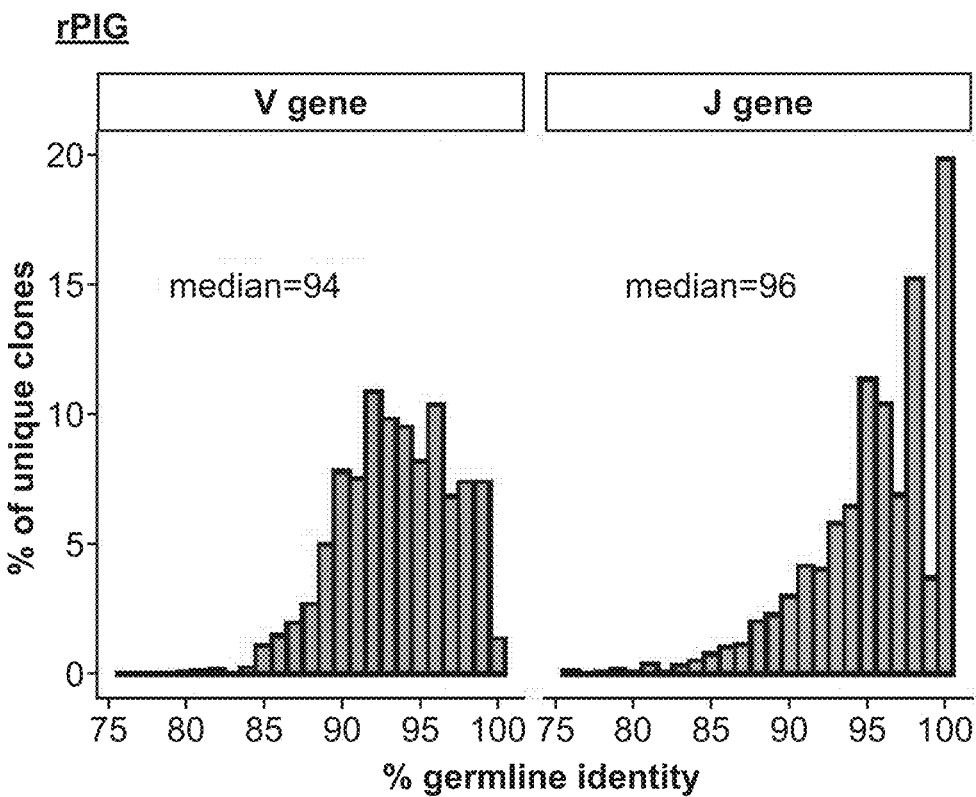

FIG. 35B is a histogram showing distribution of percent germline identity for variable gene (V; left panel) and joining gene (J; right panel), from the final CHO library.

Figure 35C:
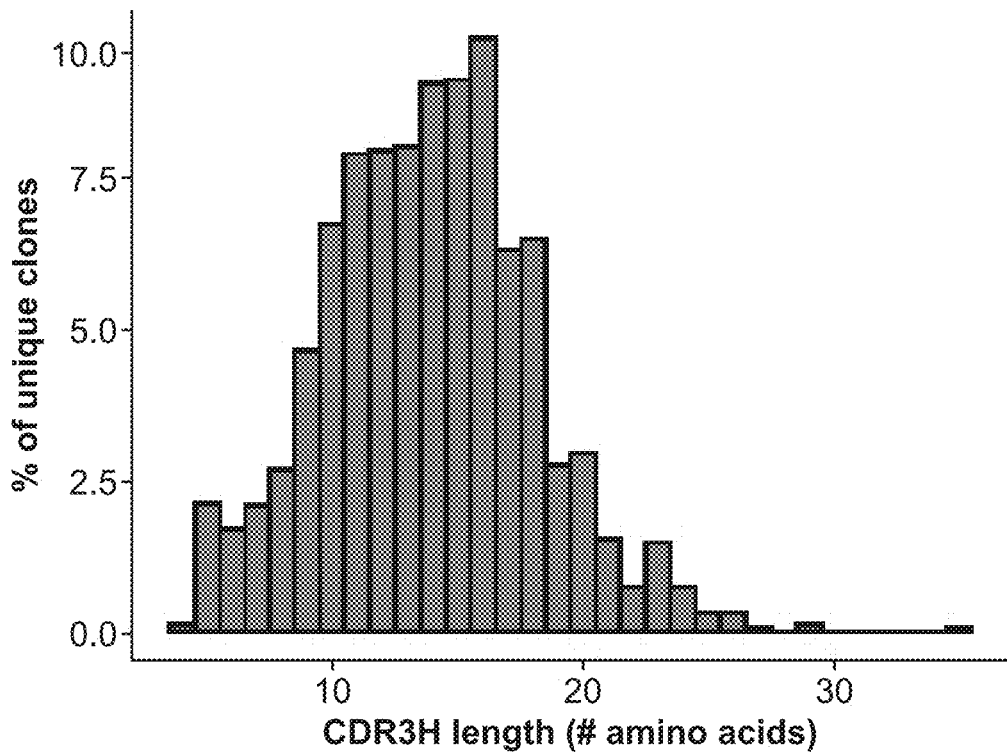

FIG. 35C is a histogram showing the distribution of heavy chain CDR3 amino acid length, from the final CHO library.

Figure 35D:

FIG. 35D. (d) Left: The clonal cluster analysis of Rpig antibodies, modified from FIG. 4a (from the final CHO library). Right: Sequence logos of all heavy chain sequences from the top five clusters (based on clone count). The first 8 amino acids (variable region primer binding sites) are not shown. FIG. 35D discloses SEQ ID NOS: 8425-8429, respectively, in order of appearance.

Figures 36A, 36B:
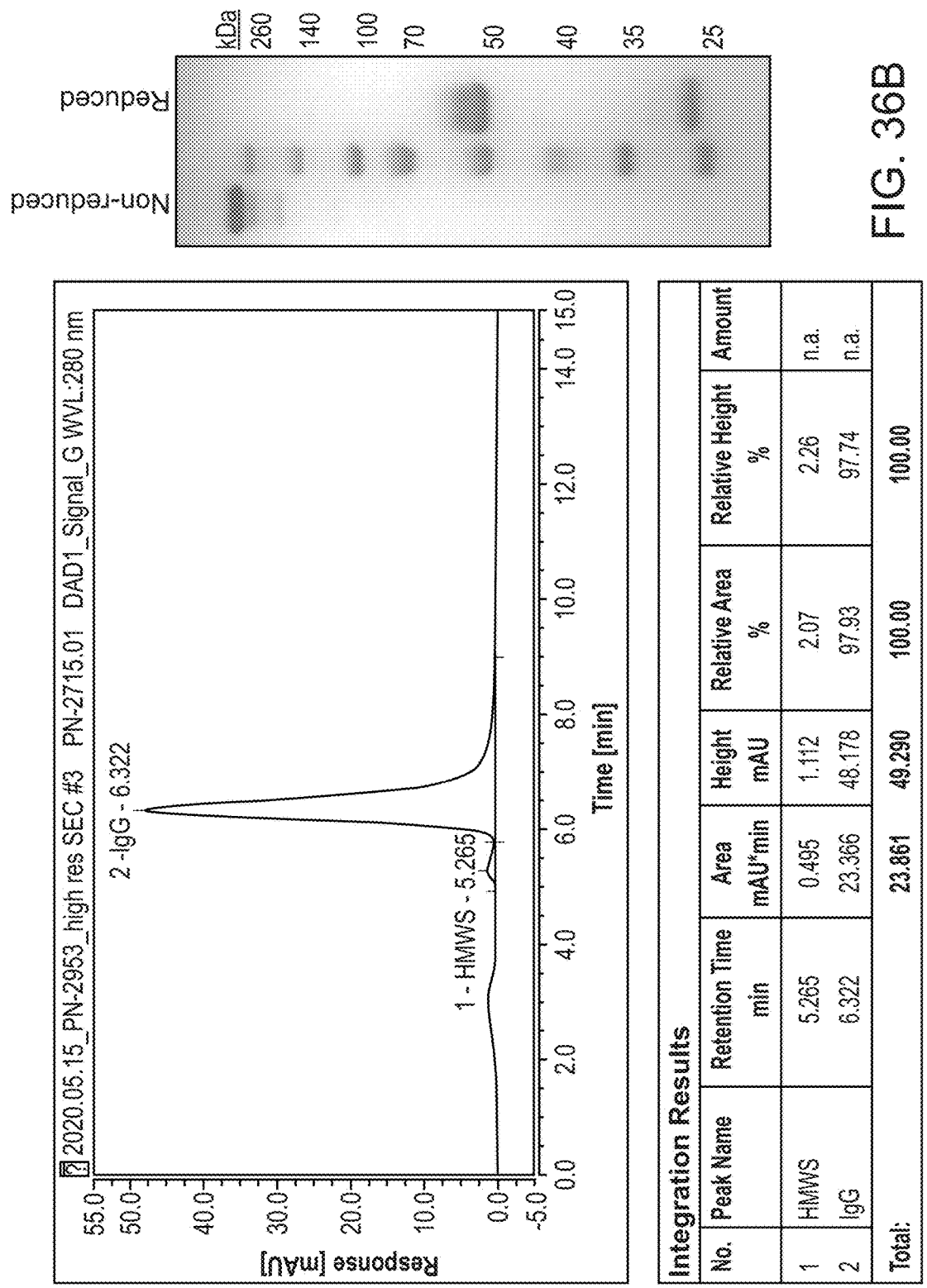

FIGS. 36A and 36B show quality control analysis of purified rHIG protein. FIG. 36A is from SEC-HPLC analysis used to assess the purity of the Protein A-purified protein. FIG. 36B is from SDS-PAGE analysis used to assess the purity of the Protein A-purified protein.

Figure 37A:
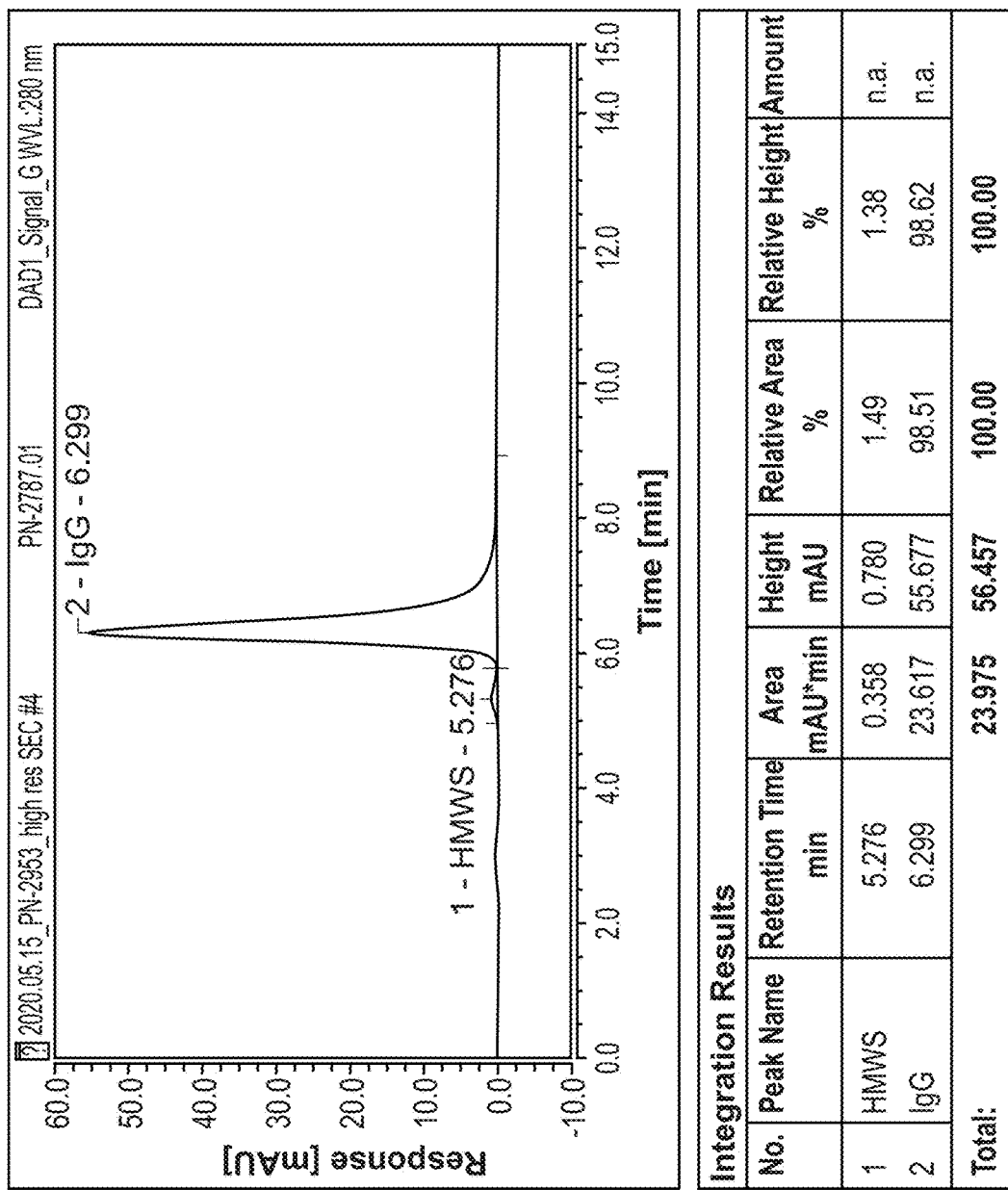
Figure 37B:
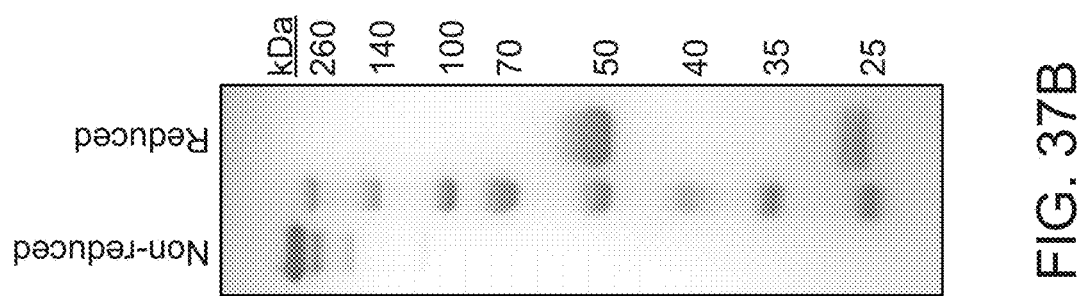

FIGS. 37A and 37B show quality control analysis of purified rPIG protein. FIG. 37A is from SEC-HPLC analysis were used to assess the purity of the Protein A-purified protein. FIG. 37B is from SDS-PAGE analysis used to assess the purity of the Protein A-purified protein.

Figure 38:
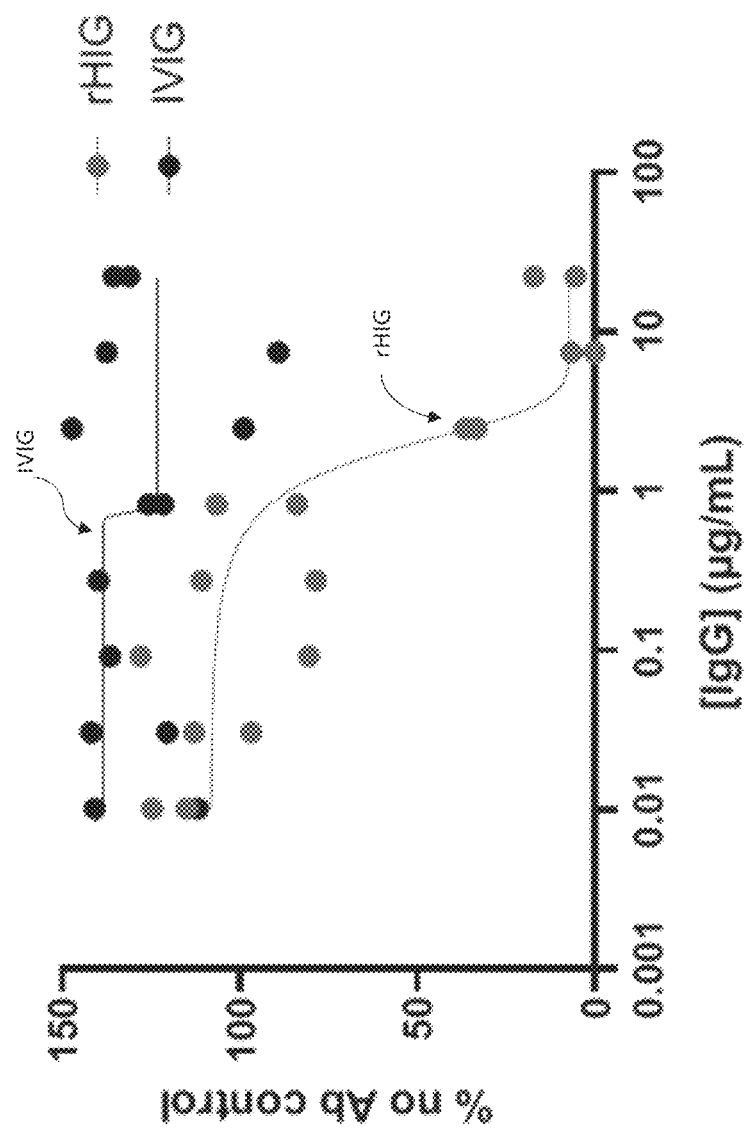

FIG. 38 provides data from *Haemophilus influenzae* serum bactericidal assay (SBA). rHIG and IVIG were serially diluted and co-incubated with $5 \times 10^4$ CFU/mL *Haemophilus influenzae* Eagan strain. After incubation, complement was added, incubated, and test samples were plated on chocolate agar. After 16 hours incubation, bacteria colony counts for each serial dilution were quantified and divided by the bacteria colony counts in the no Ab control.

Figure 39:
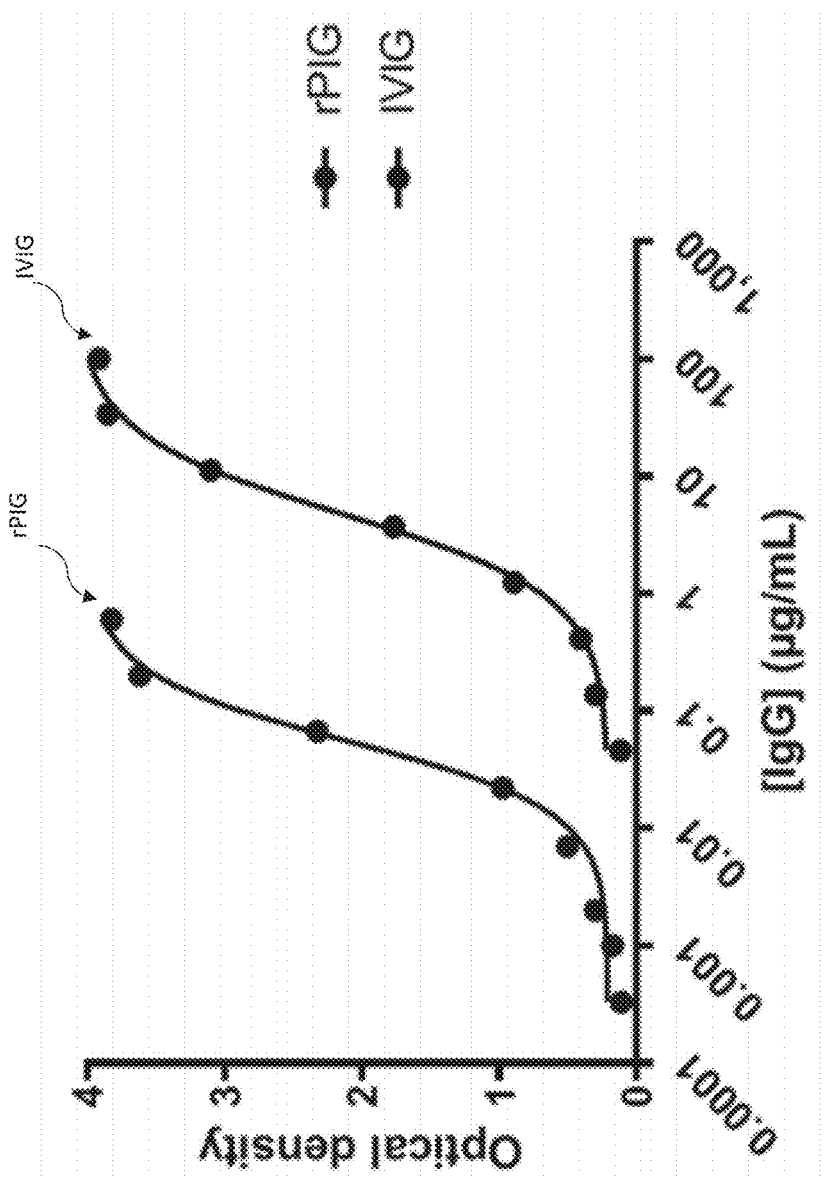

FIG. 39 provides data from Pneumococcal antibody binding assay using ELISA. Binding of serially diluted rPIG and IVIG to a pool of 23 pneumococcal polysaccharides was measured by ELISA.

Figure 40A:
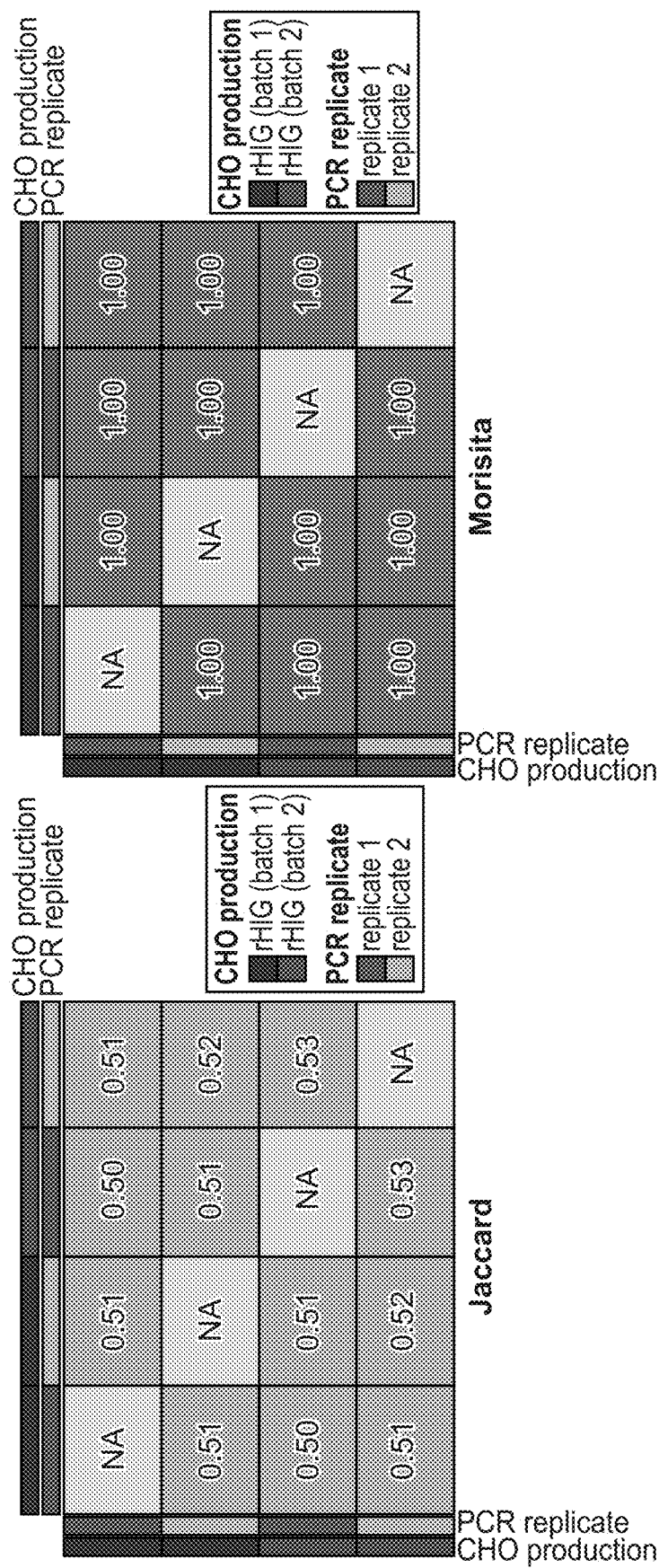
Figure 40B:
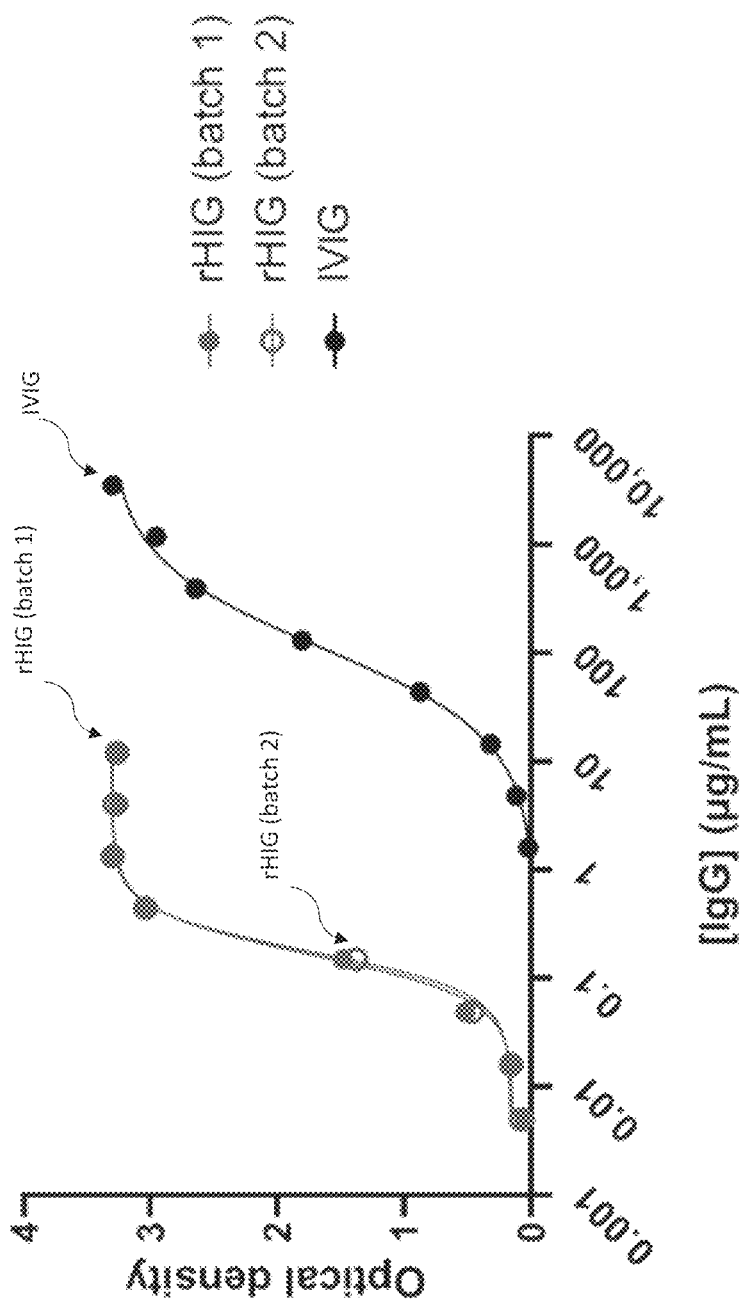

FIG. 40A to 40B show measurement of batch-to-batch variation of rHIG. (FIG. 40A) RNA antibody sequencing was performed (in duplicate) on RNA isolated from the end of replicate CHO bioreactor production runs. Jaccard (left) and Morisita (right) analyses showed that the amount of antibody clone variation between production batches and between PCR replicates performed on each batch. Wilcoxon rank sum tests showed that the indices from the PCR replicates came from the same population as the indices from the batch replicates (p>0.05), suggesting that the variability inherent to the batches was no worse than the variability between PCR replicates. FIG. 40B show binding of the indicated batch of serially diluted rHIG and IVIG to Hib as measured by ELISA.

Figure 41A:
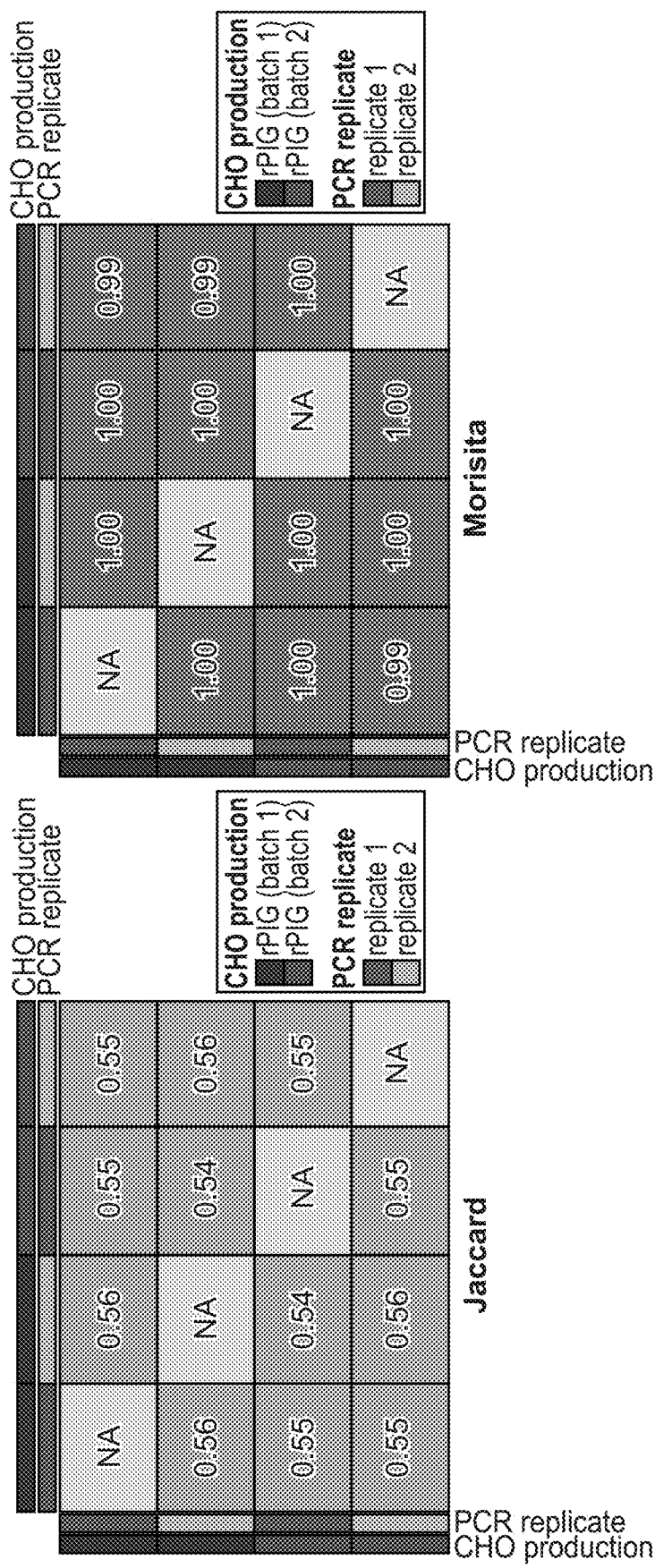
Figure 41B:
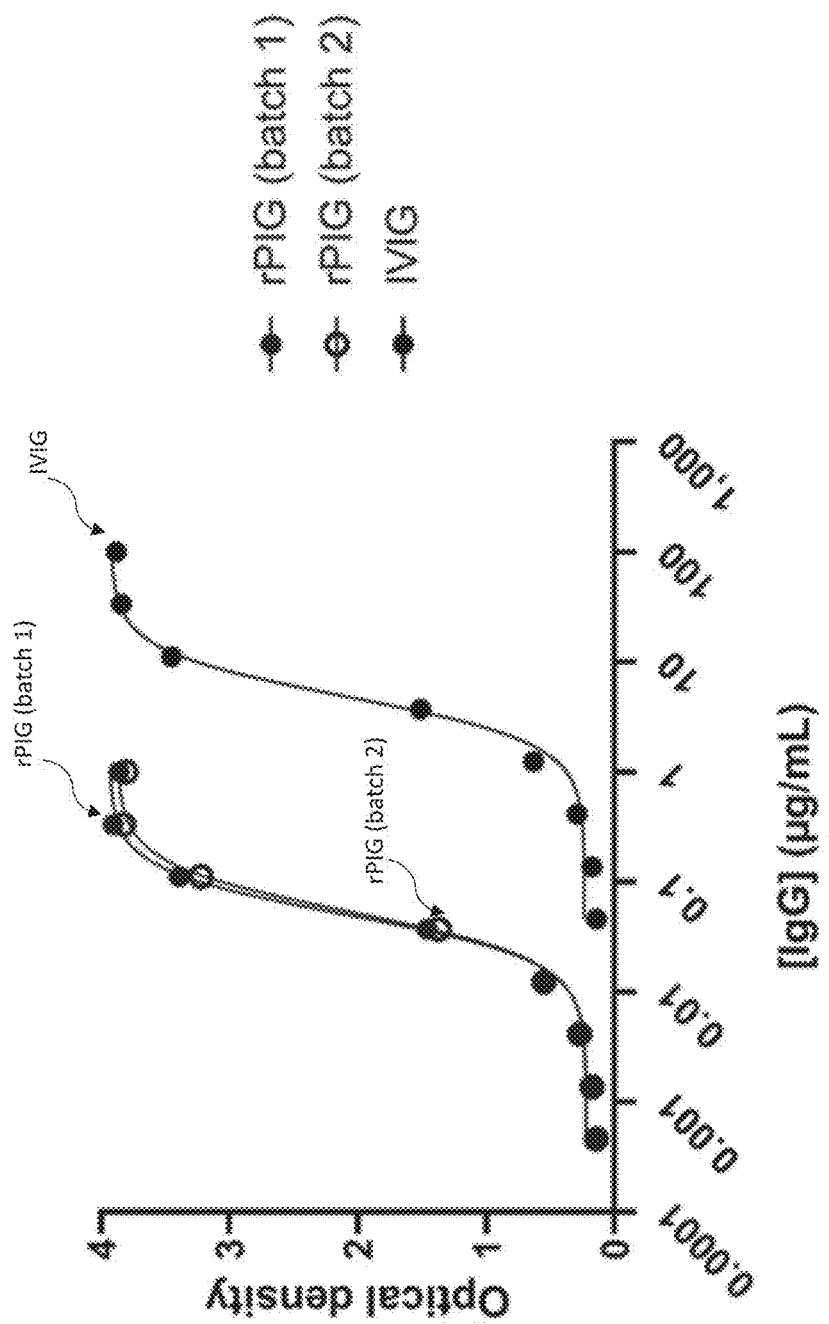

FIG. 41A and FIG. 41B show measurement of batch-to-batch variation of rPIG. (FIG. 41A) RNA antibody sequencing was performed (in duplicate) on RNA isolated from the end of replicate CHO bioreactor production runs. Jaccard (left) and Morisita (right) analyses showed that the amount of antibody clone variation between production batches and between PCR replicates performed on each batch. Wilcoxon rank sum tests showed that the indices from the PCR replicates came from the same population as the indices from the batch replicates (p>0.05), suggesting that the variability inherent to the batches was no worse than the variability between PCR replicates. FIG. 41B shows binding of the indicated batch of serially diluted rPIG and IVIG to a pool of 23 pneumococcal polysaccharides as measured by ELISA.

Figures 42A, 42B:
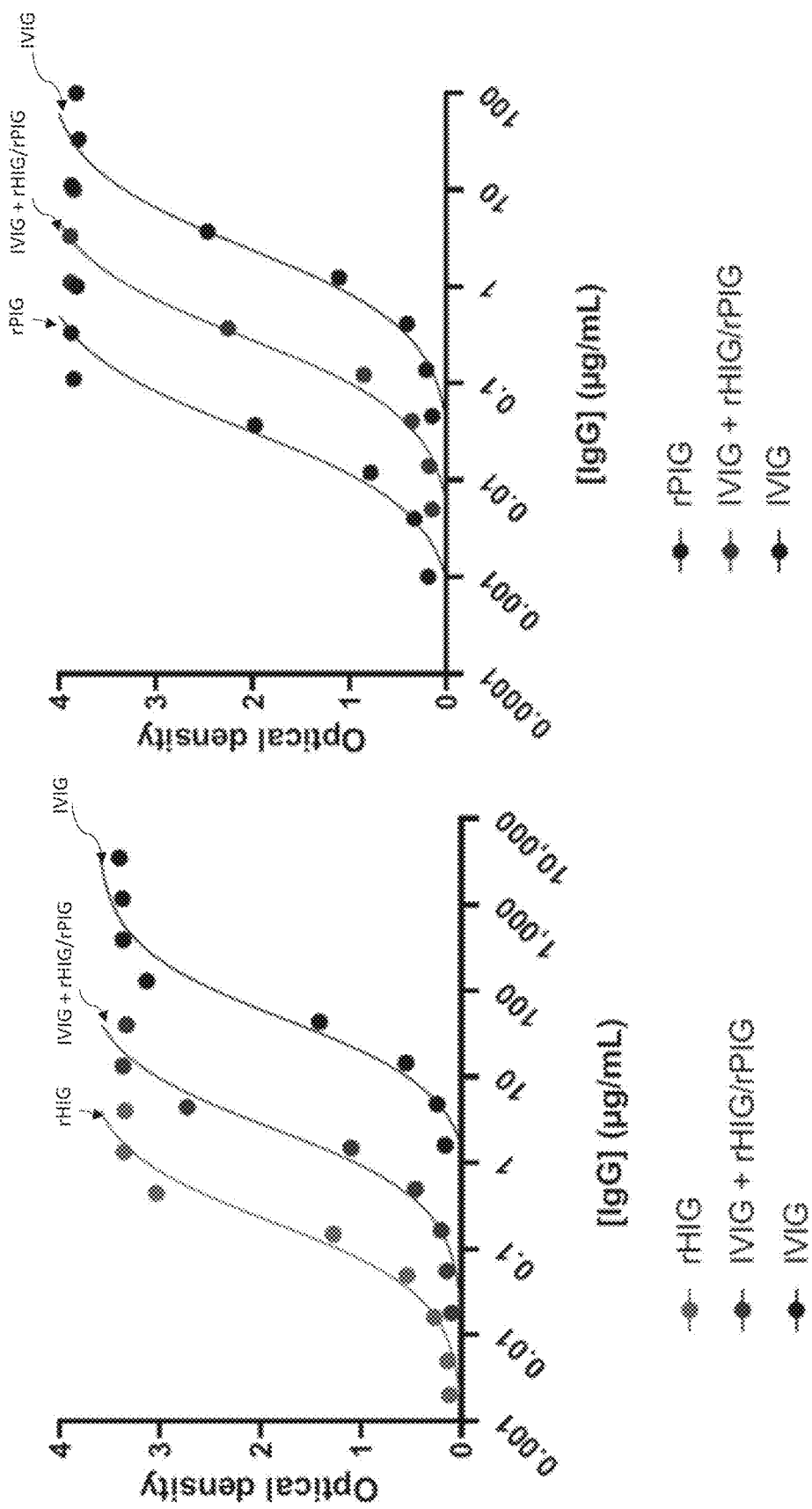

FIGS. 42A and 42B show Pneumococcal or Hib antibody binding of IVIG+rHIG/rPIG by ELISA. FIG. 42A shows binding of serially diluted rHIG, IVIG+rHIG/rPIG, and IVIG to Hib, measured by ELISA. FIG. 42B shows binding of serially diluted rPIG, IVIG+rHIG/rPIG, and IVIG to a pool of 23 pneumococcal polysaccharides, measured by ELISA.

FIG. 43A illustrates procedures for immunizing three Trianni mice weekly with T cells isolated from one human donor with ALD/MDP adjuvant. After week 5, serum from the mice was tested to confirm binding to T cells before a final boost without adjuvant 5 days prior to harvesting the organ B cells.

Figure 43B:
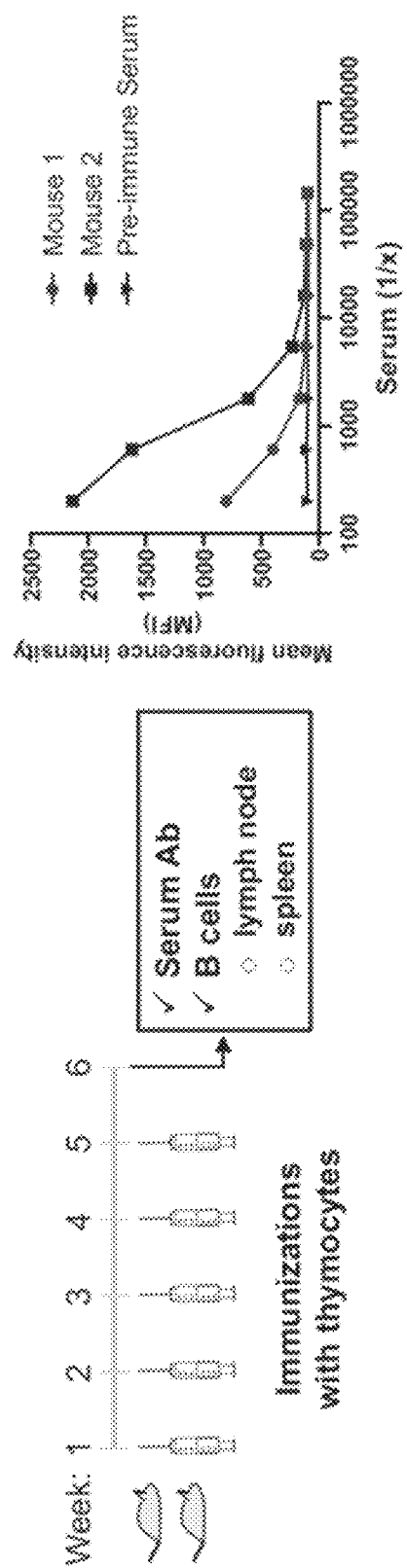

FIG. 43B illustrates procedures for immunizing two Trianni mice weekly with thymocytes isolated from five separate human donors with ALD/MDP adjuvant. After week 5, serum from the mice was tested to confirm binding to T cells before a final boost without adjuvant 5 days prior to harvesting the organ B cells.

Figure 44A:
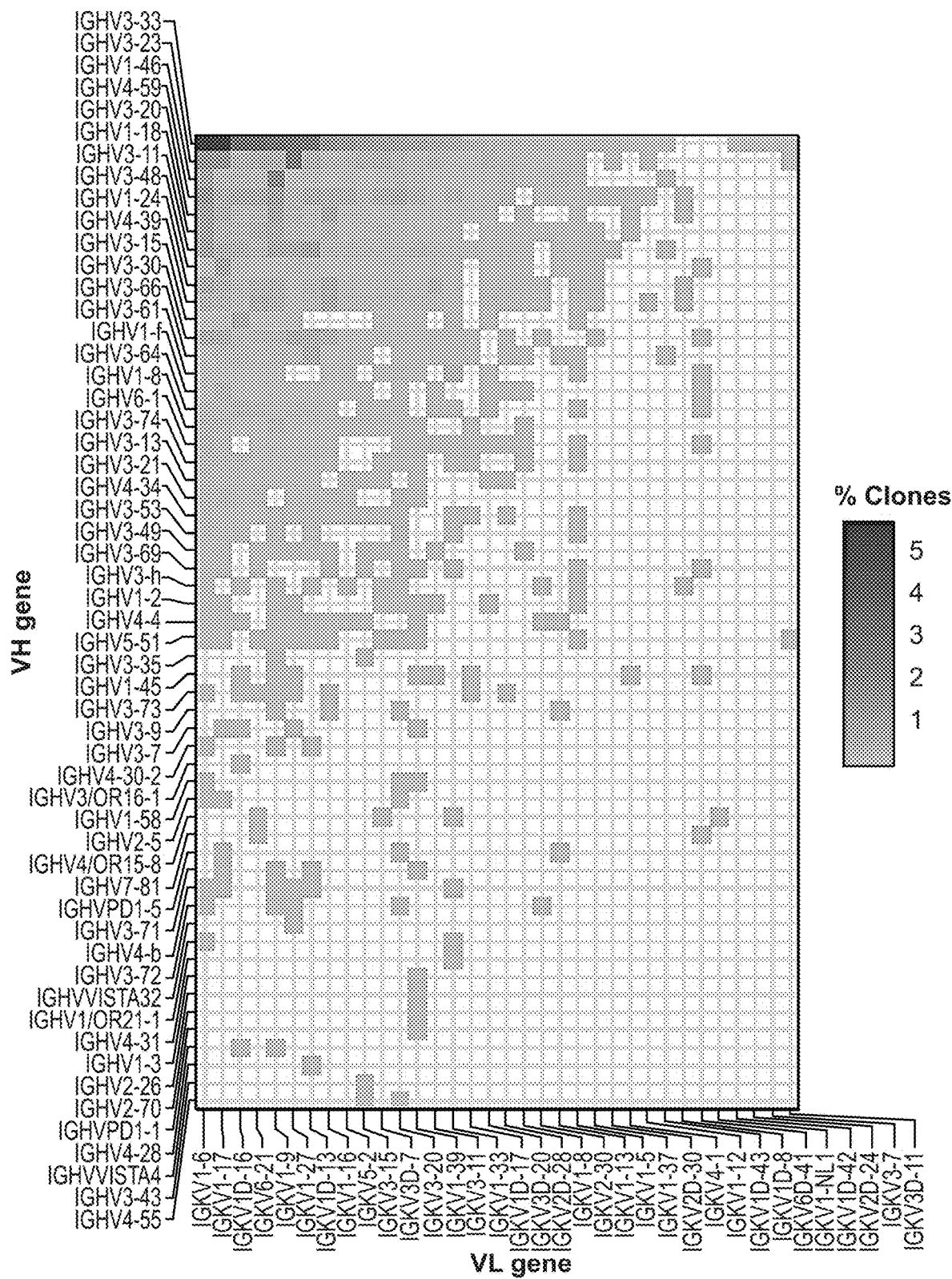

FIG. 44A is a heatmap showing antibody variable (V) gene usage from the linked scFv library (the 4 libraries combined). The x-axis and y-axis show light and heavy chain V genes, respectively. The greyscale represents percent unique clone abundance in the library.

Figure 44B:
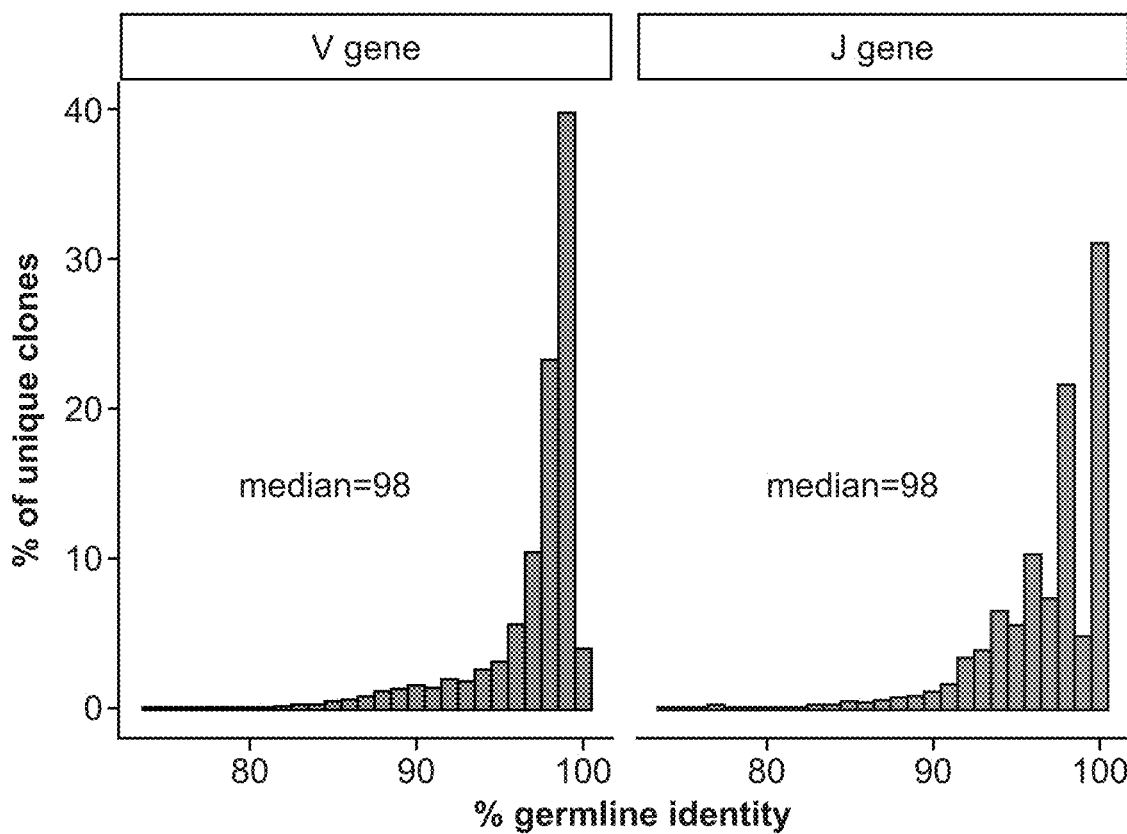

FIG. 44B provides a histogram showing distribution of percent germline identity for variable gene (V; left panel) and joining gene (J; right panel), from the final CHO library.

Figure 44C:
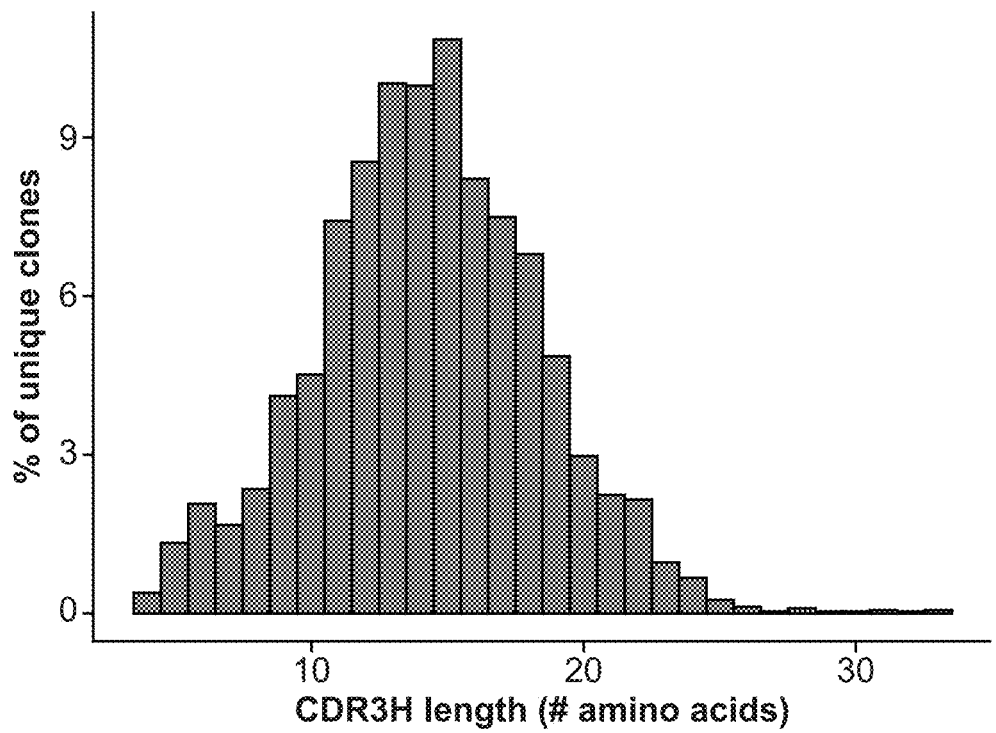

FIG. 44C is a histogram showing the distribution of heavy chain CDR3 amino acid length, from the final CHO library.

Figure 44D:
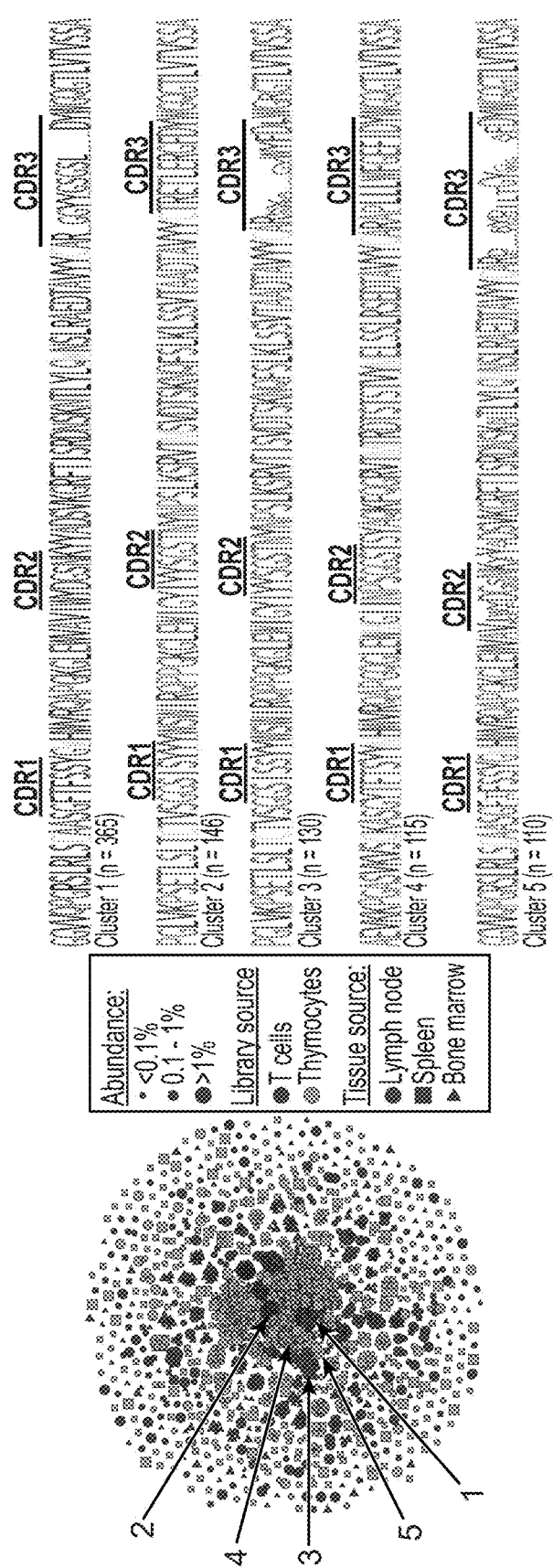

FIG. 44D. Left: The clonal cluster analysis of rhATG antibodies from FIG. 11A (from the CHO libraries). Right: Sequence logos of all heavy chain sequences from the top five clusters (based on clone count). The first 8 amino acids (variable region primer binding sites) are not shown. FIG. 44D discloses SEQ ID NOS: 8430-8434, respectively, in order of appearance.

Figure 45A:
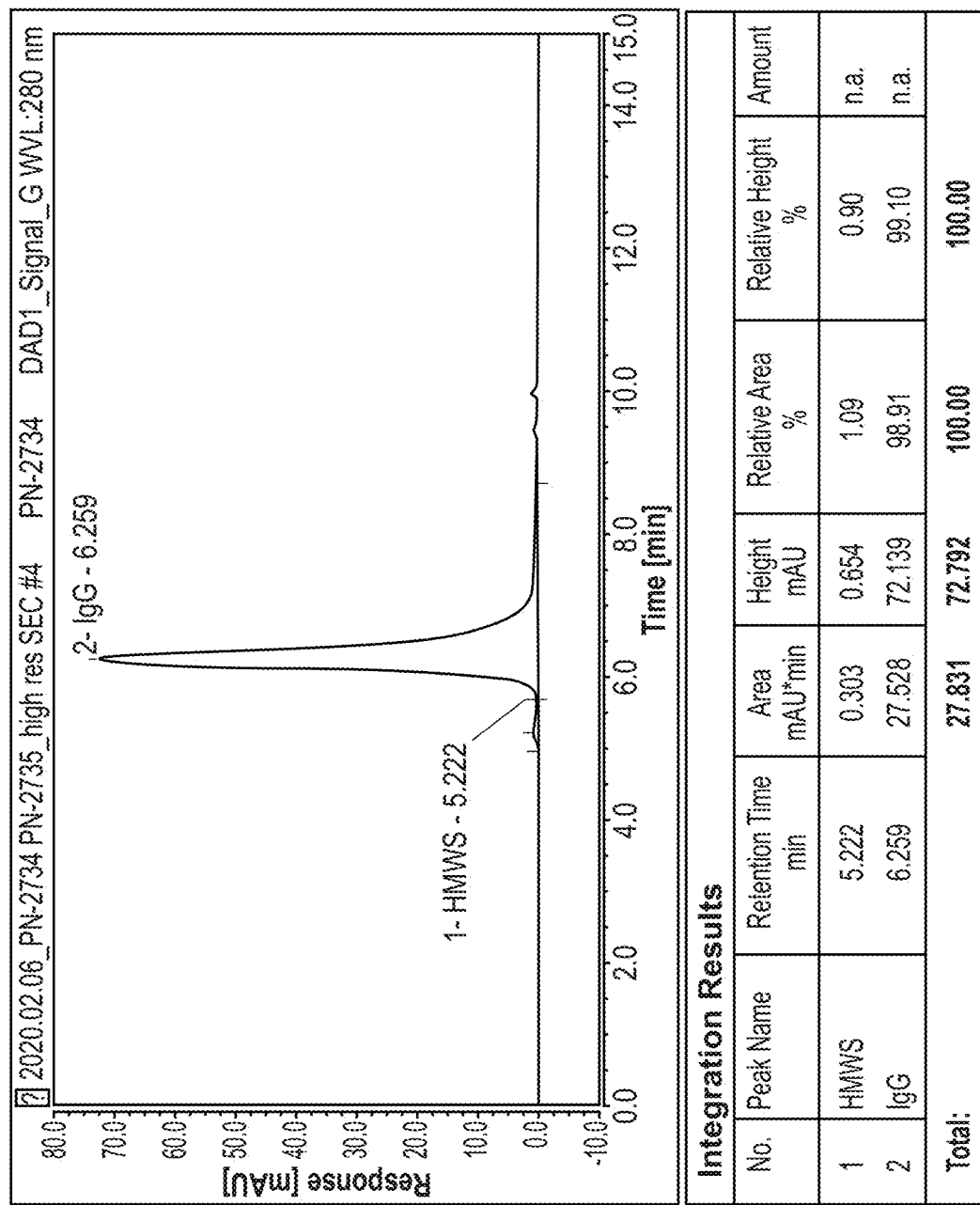
Figure 45B:
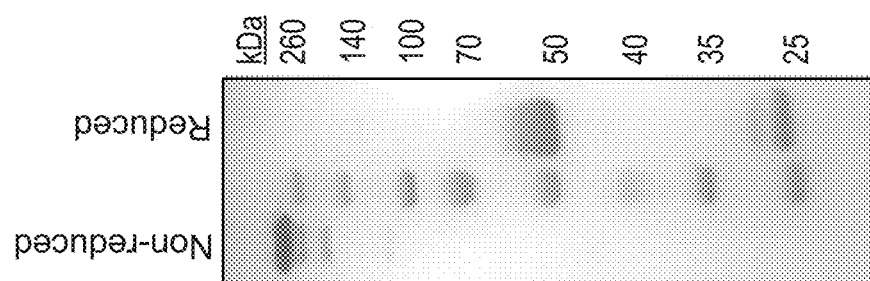

FIG. 45A-45B shows quality control analysis of purified rhATG protein. FIG. 45A shows a result from SEC-HPLC analysis used to assess the purity of the Protein A-purified protein. FIG. 45B shows a result from SDS-PAGE analysis used to assess the purity of the Protein A-purified protein.

Figures 46A, 46B:
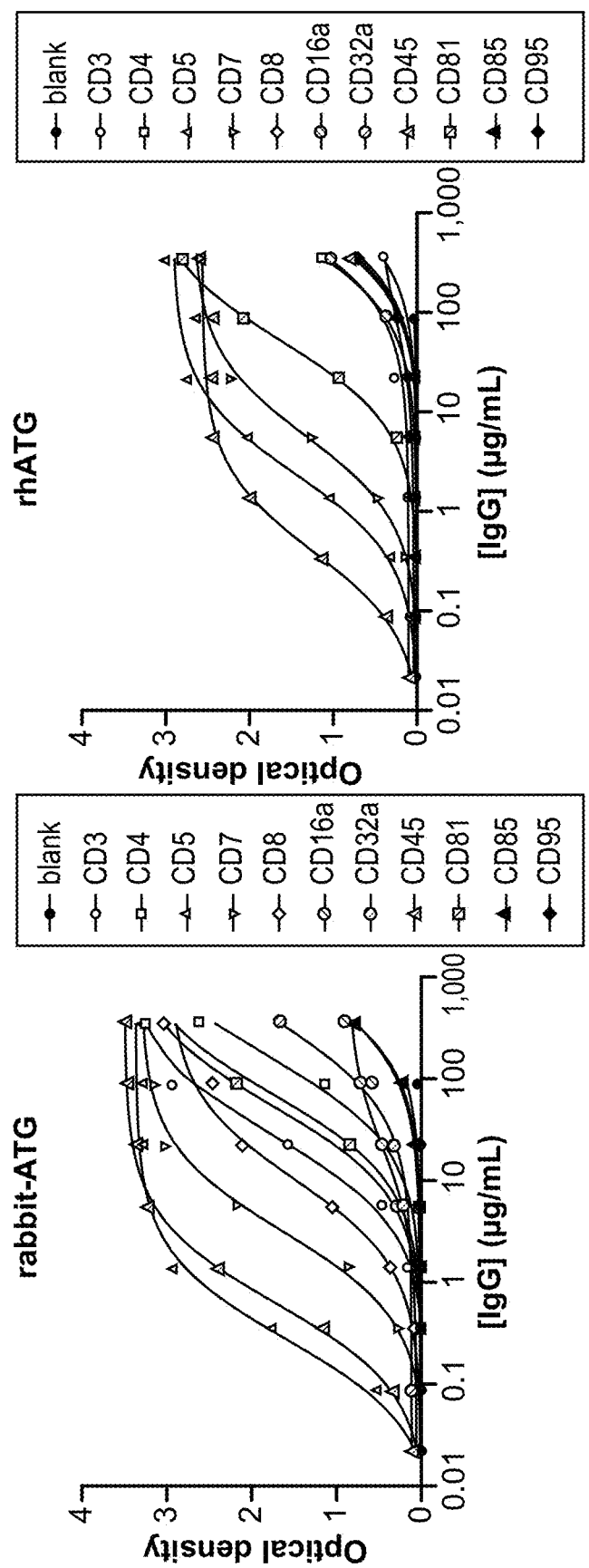

FIG. 46A-46B show ATG immune cell-specific antibody responses measure by ELISA. The indicated Immune cell antigens were coated onto ELISA plates. (FIG. 46A) rabbit-ATG was serially diluted and added to the plate. Antibody bound to antigens were quantified by anti-rabbit-HRP or anti-human-HRP, respectively. (FIG. 46B) h-ATG were serially diluted and added to the plate. Antibody bound to antigens were quantified by anti-rabbit-HRP or anti-human-HRP, respectively.

Figure 47:
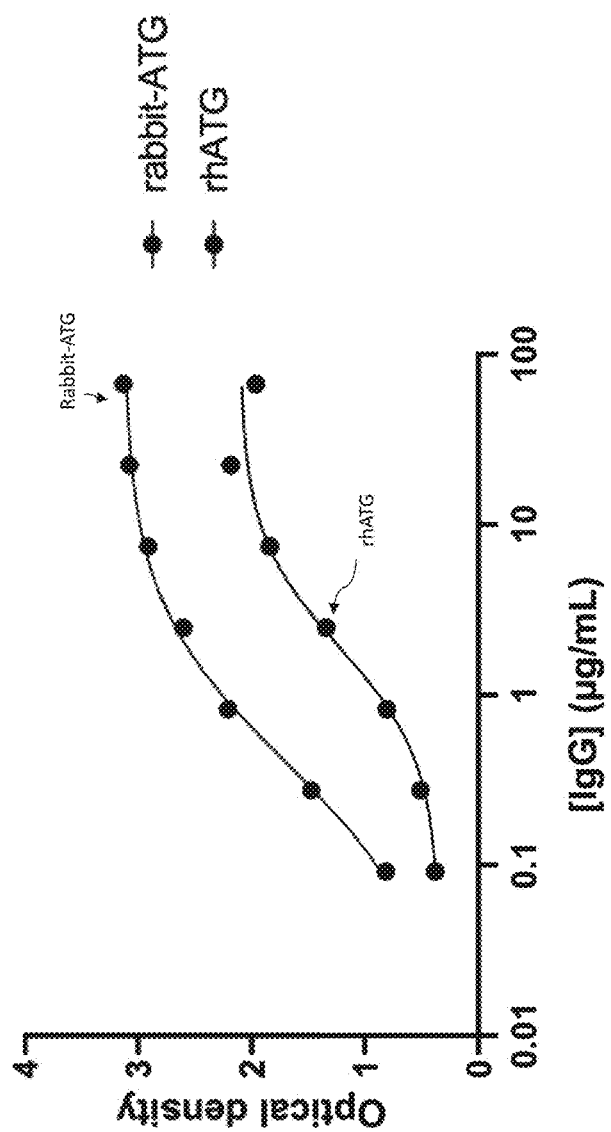

FIG. 47 shows ATG binding to red blood cells by ELISA. RBC-specific antibody response was measured by Immucor Capture-R ELISA. Rabbit-ATG and rhATG were serially diluted and added to the Immucor Capture-R plate. RBC-bound antibodies were quantified by anti-rabbit-HRP or anti-human-HRP, respectively.

Figure 48A:
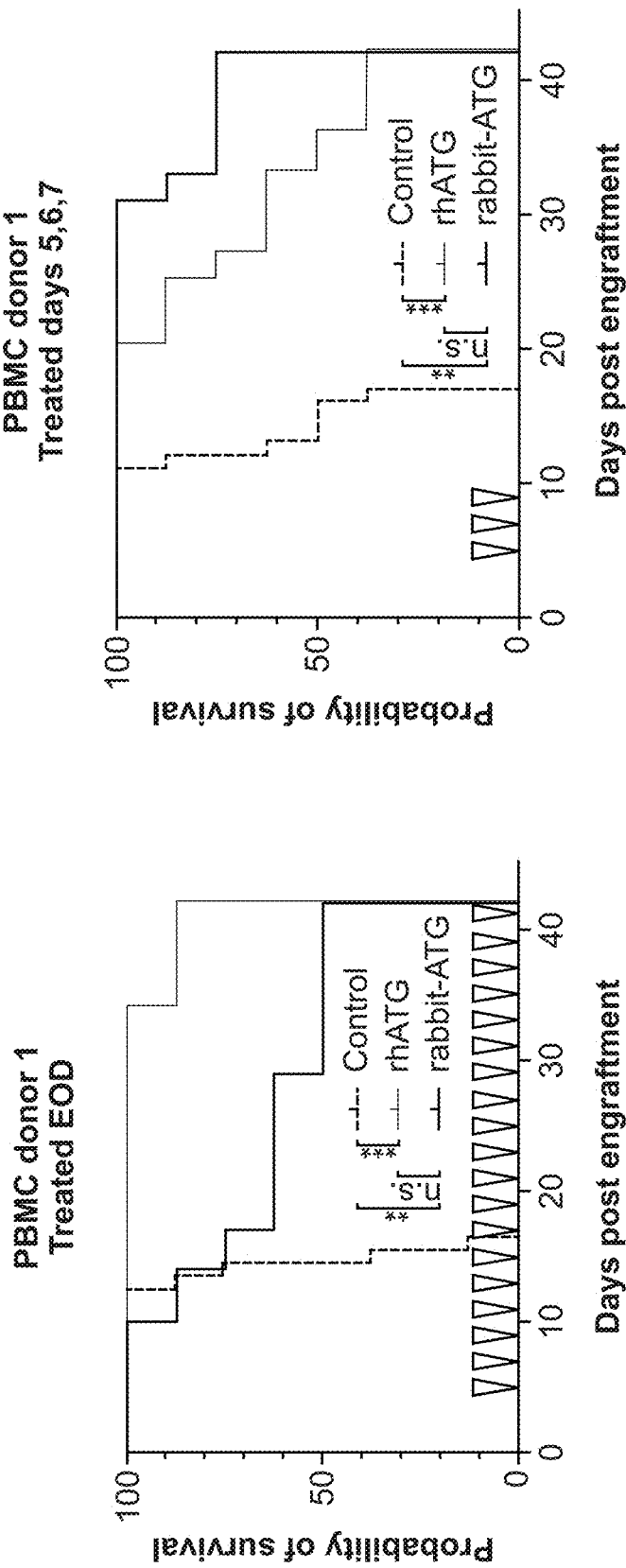
Figure 48B:
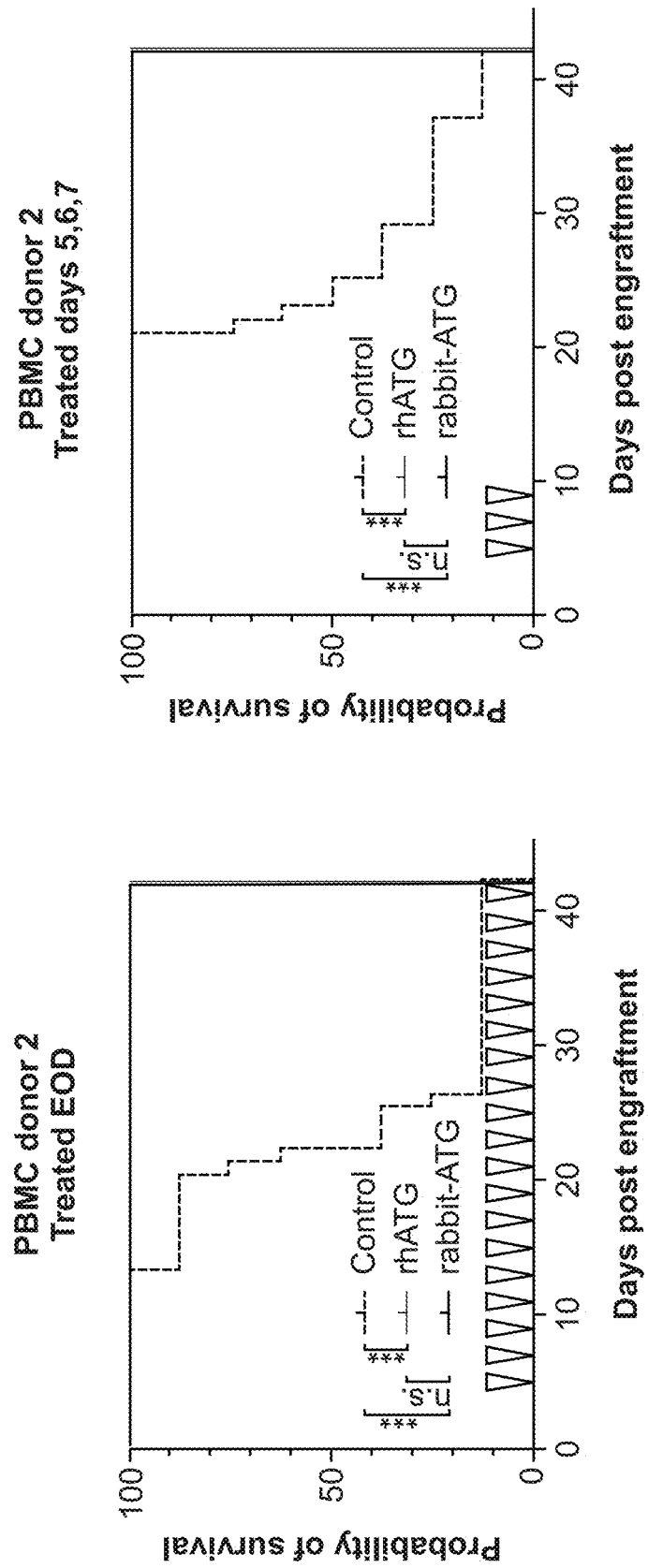

FIGS. 48A and 48B show survival of mice in the GVHD study after ATG treatment. (FIG. 48A) Eight animals per treatment group were engrafted with $10^7$ PBMC from one of two donors. Animals were treated with rhATG, rabbit-ATG, or vehicle control either every other day beginning at day 5 or on days 5, 6, and 7 (treatment days are indicated by triangles), then monitored for progression to GVHD and death.  $p<0.01$, * $p<0.001$, n.s. not significant. (FIG. 48B) Eight animals per treatment group were engrafted with $10^7$ PBMC from one of two donors. Animals were treated with rhATG, rabbit-ATG, or vehicle control either every other day beginning at day 5 or on days 5, 6, and 7 (treatment days are indicated by triangles), then monitored for progression to GVHD and death.  $p<0.01$, * $p<0.001$, n.s. not significant.

Figure 49A:
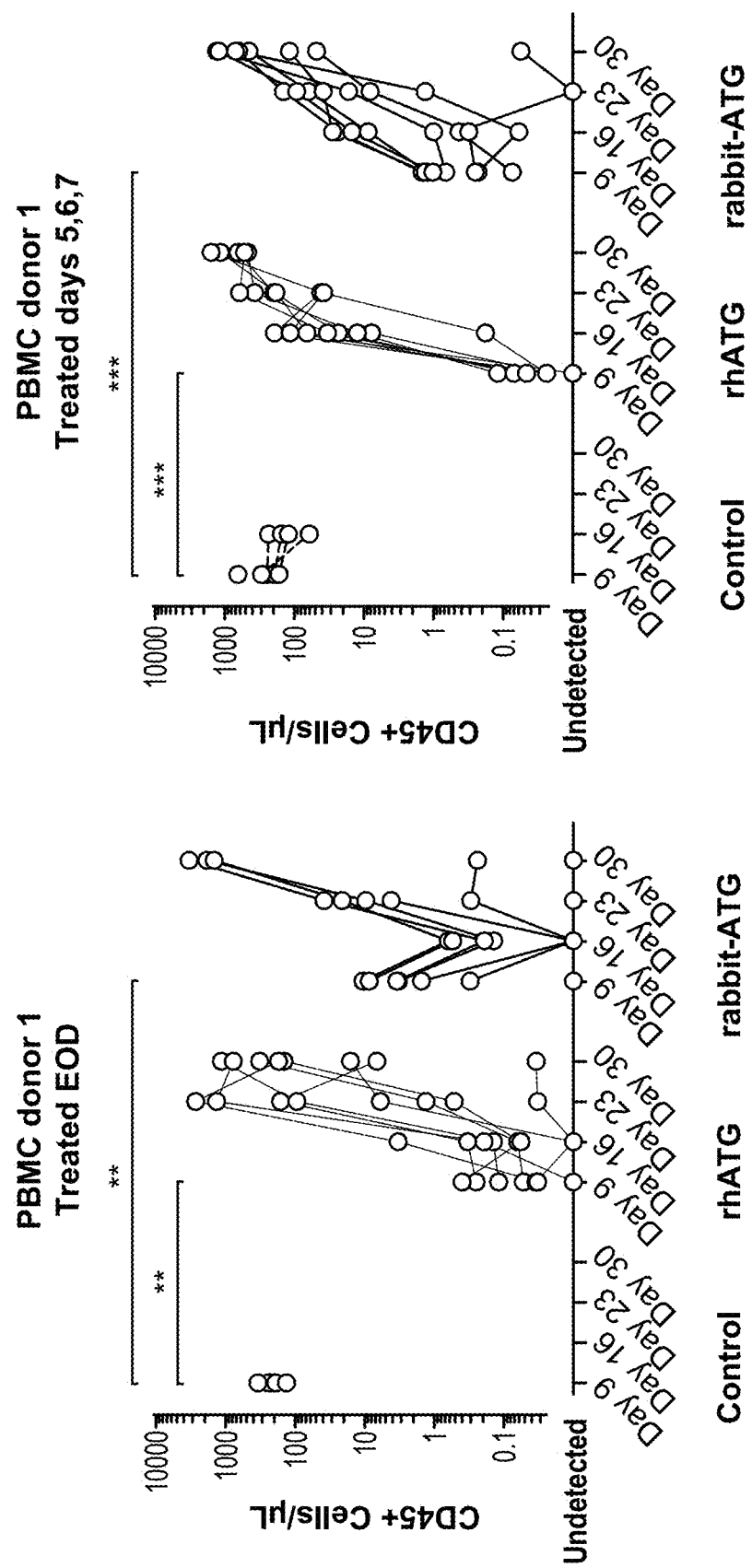
Figure 49B:
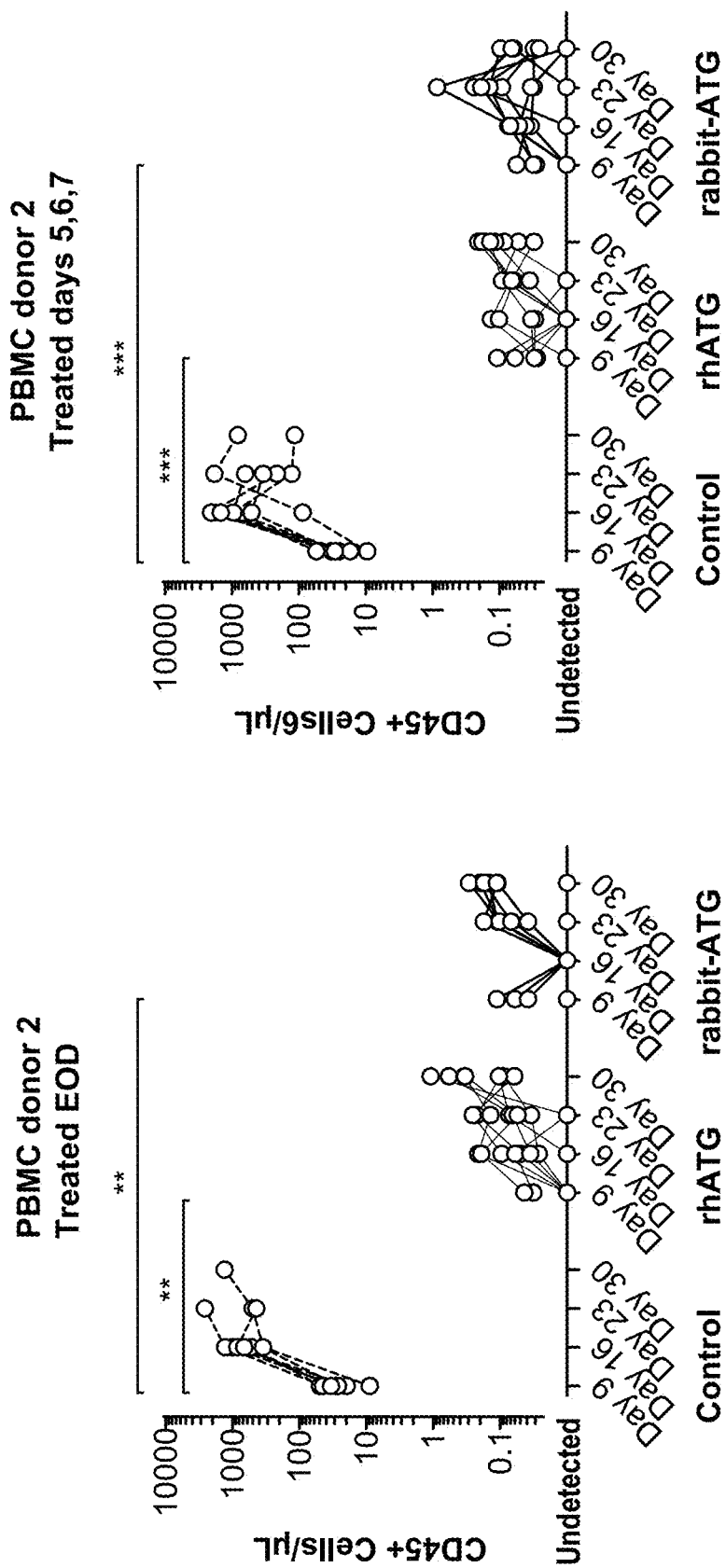

FIGS. 49A and 49B show flow cytometry of CD45+ cells from the ATG GVHD study. (FIG. 49A) Eight animals per treatment group were engrafted with $10^7$ PBMC from one of two donors. Animals were treated with rhATG, rabbit-ATG, or vehicle control either every other day beginning at day 5 or on days 5, 6, and 7. Flow cytometry was used to determine the concentration of CD45+ cells from each alive mouse on Days 9, 16, 23, and 30. Lines connect measurements from each mouse. No CD45+ cells were observed where circles intercept the x-axis.  $p<0.01$, * $p<0.001$.

(FIG. 49B) Eight animals per treatment group were engrafted with $10^7$ PBMC from one of two donors. Animals were treated with rhATG, rabbit-ATG, or vehicle control either every other day beginning at day 5 or on days 5, 6, and 7. Flow cytometry was used to determine the concentration of CD45+ cells from each alive mouse on Days 9, 16, 23, and 30. Lines connect measurements from each mouse. No CD45+ cells were observed where circles intercept the x-axis.  $p<0.01$, * $p<0.001$.

Figure 50A:
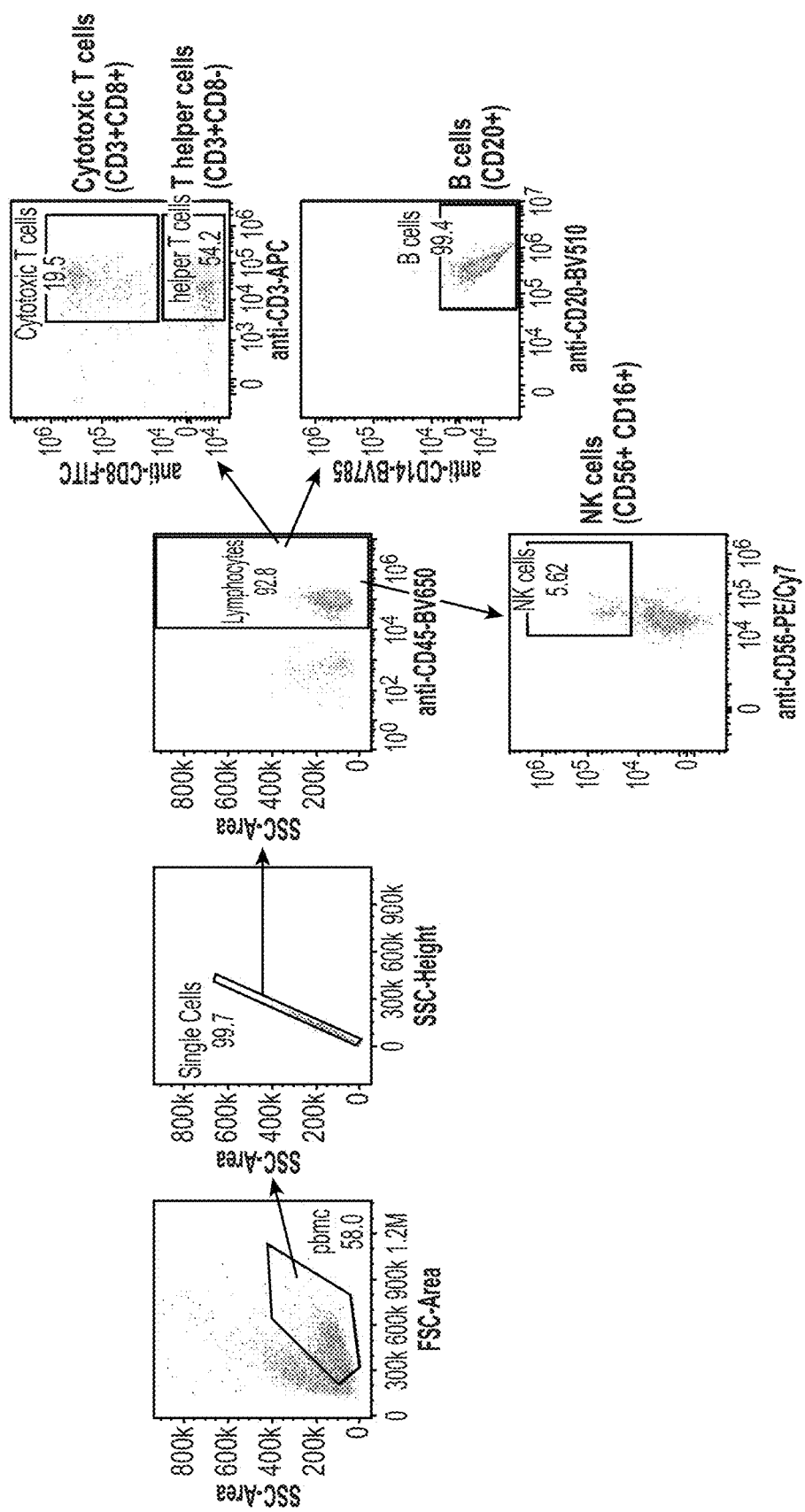
Figure 50B:
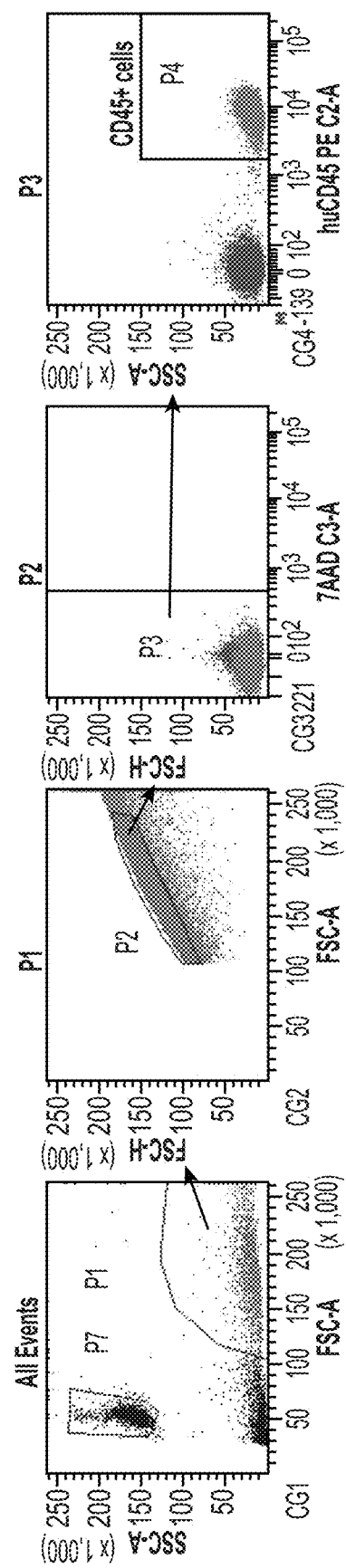

FIGS. 50A and 50B show ATG assay flow gating strategies. (FIG. 50A) Flow gating strategy for the ATG PBMC killing assay to quantify cytotoxic T cells, T helper cells, B cells, and NK cells. (FIG. 50B) Flow gating strategy of the GVH study to quantify CD45+ cells.

FIGS. 51A and 51B show data from SARS-CoV-2 pseudotype virus neutralization assay. Wuhan-Hu-1 as well as arising SARS-CoV-2 variants (B.1.1.7 (UK), B.1.351 (South Africa), P.1 (Japanese/Brazilian), and B.1.427/B.1.429 (California)) were psudotyped and tested. FIG. 51A shows % of infected cells normalized to infected cells under a control condition without application of antibodies. FIG. 51B summarizes $IC_{50}$ value (μg/mL) for psudotype virus of the tested SARS-CoV-2 variants.

7. DETAILED DESCRIPTION

Definitions

Unless otherwise defined herein, scientific and technical terms used in connection with the present invention shall have the meanings that are commonly understood by those of ordinary skill in the art. Further, unless otherwise required by context, singular terms shall include pluralities and plural terms shall include the singular. Generally, nomenclatures used in connection with, and techniques of, cell and tissue culture, molecular biology, immunology, microbiology, genetics and protein and nucleic acid chemistry and hybridization described herein are those well-known and commonly used in the art. The methods and techniques of the present invention are generally performed according to conventional methods well known in the art and as described in various general and more specific references that are cited and discussed throughout the present specification unless otherwise indicated. See, e.g., Sambrook et al. *Molecular Cloning: A Laboratory Manual, 2d ed.*, Cold Spring Harbor Laboratory Press, Cold Spring Harbor, N.Y. (1989) and Ausubel et al., *Current Protocols in Molecular Biology*, Greene Publishing Associates (1992), and Harlow and Lane *Antibodies: A Laboratory Manual* Cold Spring Harbor Laboratory Press, Cold Spring Harbor, N.Y. (1990), which are incorporated herein by reference. Enzymatic reactions and purification techniques are performed according to manufacturer's specifications, as commonly accomplished in the art or as described herein. The terminology used in connection with, and the laboratory procedures and techniques of, analytical chemistry, synthetic organic chemistry, and medicinal and pharmaceutical chemistry described herein are those well-known and commonly used in the art. Standard techniques can be used for chemical syntheses, chemical analyses, pharmaceutical preparation, formulation, and delivery, and treatment of patients.

The following terms, unless otherwise indicated, shall be understood to have the following meanings:

The term "recombinant polyclonal protein" or "RPP" refers to more than one recombinant antigen binding proteins (ABPs), collectively comprising more than one antigen-binding domains that specifically bind to an antigen or epitope, or multiple antigens and epitopes. The recombinant polyclonal protein or RPP can be antibodies or variants or derivatives thereof. In some embodiments, the antigen-binding domains bind an antigen or epitope with specificity and affinity similar to that of a naturally occurring antibody. In some embodiments, an RPP comprises antibodies. In some embodiments, the RPP consists essentially of antibodies. In some embodiments, an RPP is a mixture of antibodies. In some embodiments, an RPP comprises scFvs. In some embodiments, the RPP comprises an alternative scaffold. In some embodiments, the RPP consists of alternative scaffolds. In some embodiments, the RPP consists essentially of alternative scaffolds. In some embodiments, the RPP comprises an antibody fragment. In some embodiments, the RPP consists of antibody fragments. In some embodiments, the RPP consists essentially of antibody fragments.

The term "antigen binding protein" or "ABP" as used herein refers to a protein comprising one or more antigen-binding domains that specifically bind to an antigen or epitope. In some embodiments, the ABP comprises an antibody. In some embodiments, the ABP consists of an antibody. In some embodiments, the ABP consists essentially of an antibody. In some embodiments, the ABP comprises an alternative scaffold. In some embodiments, the ABP consists of an alternative scaffold. In some embodiments, the ABP consists essentially of an alternative scaffold. In some embodiments, the ABP comprises an antibody fragment. In some embodiments, the ABP consists of an antibody fragment. In some embodiments, the ABP consists essentially of an antibody fragment.

The term "antibody" is used herein in its broadest sense and includes certain types of immunoglobulin molecules comprising one or more antigen-binding domains that specifically bind to an antigen or epitope. An antibody specifically includes intact antibodies (e.g., intact immunoglobulins), antibody fragments, and multi-specific antibodies. One example of an antigen-binding domain is an antigen-binding domain formed by a $V_H$-$V_L$ dimer.

The term "alternative scaffold" refers to a molecule in which one or more regions may be diversified to produce one or more antigen-binding domains that specifically bind to an antigen or epitope. In some embodiments, the antigen-binding domain binds the antigen or epitope with specificity and affinity similar to that of naturally occurring antibodies. Exemplary alternative scaffolds include those derived from fibronectin (e.g., Adnectins™), the β-sandwich (e.g., iMab), lipocalin (e.g., Anticalins®), EETI-II/AGRP, BPTI/LACI-D1/ITI-D2 (e.g., Kunitz domains), thioredoxin peptide aptamers, protein A (e.g., Affibody®), ankyrin repeats (e.g., DARPins), gamma-B-crystallin/ubiquitin (e.g., Affilins), $CTLD_3$ (e.g., Tetranectins), Fynomers, and (LDLR-A module) (e.g., Avimers). Additional information on alternative scaffolds is provided in Binz et al., Nat. Biotechnol., 2005 23:1257-1268; Skerra, Current Opin. in Biotech., 2007 18:295-304; and Silacci et al., J. Biol. Chem., 2014, 289: 14392-14398; each of which is incorporated by reference in its entirety. Alternative scaffolds comprise one type of RPP.

The term "antigen-binding domain" means the portion of an antibody that is capable of specifically binding to an antigen or epitope.

The terms "full length antibody," "intact antibody," and "whole antibody" are used herein interchangeably to refer to an antibody having a structure substantially similar to a naturally occurring antibody structure and having heavy chains that comprise an Fc region.

The term "immunoglobulin" refers to a class of structurally related proteins, e.g., antibodies, generally comprising two pairs of polypeptide chains: one pair of light (L) chains and one pair of heavy (H) chains. In an "intact immunoglobulin," all four of these chains are interconnected by disulfide bonds. The structure of immunoglobulins has been well characterized. See, e.g., Paul, Fundamental Immunology 7th ed., Ch. 5 (2013) Lippincott Williams & Wilkins, Philadelphia, Pa. Briefly, each heavy chain typically comprises a heavy chain variable region ($V_H$) and a heavy chain constant region ($C_H$). The heavy chain constant region typically comprises three domains, abbreviated $C_{H1}$, $C_{H2}$, and $C_{H3}$. Each light chain typically comprises a light chain variable region ($V_L$) and a light chain constant region. The light chain constant region typically comprises one domain, abbreviated $C_L$.

The term "Fc region" means the C-terminal region of an immunoglobulin heavy chain that, in naturally occurring antibodies, interacts with Fc receptors and certain proteins of the complement system. The structures of the Fc regions of various immunoglobulins, and the glycosylation sites contained therein, are known in the art. See Schroeder and Cavacini, J. Allergy Clin. Immunol., 2010, 125:S41-52, incorporated by reference in its entirety. The Fc region may be a naturally occurring Fc region, or an Fc region modified as described elsewhere in this disclosure.

The $V_H$ and $V_L$ regions may be further subdivided into regions of hypervariability ("hypervariable regions (HVRs)" also called "complementarity determining regions" (CDRs)) interspersed with regions that are more conserved. The more conserved regions are called framework regions (FRs). Each $V_H$ and $V_L$ generally comprises three CDRs and four FRs, arranged in the following order (from N-terminus to C-terminus): FR1-CDR1-FR2-CDR2-FR3-CDR3-FR4. The CDRs are involved in antigen binding, and influence antigen specificity and binding affinity of the antibody. See Kabat et al., Sequences of Proteins of Immunological Interest 5th ed. (1991) Public Health Service, National Institutes of Health, Bethesda, Md., incorporated by reference in its entirety.

The light chain from any vertebrate species can be assigned to one of two types, called kappa (κ) and lambda (λ), based on the sequence of its constant domain.

The heavy chain from any vertebrate species can be assigned to one of five different classes (or isotypes): IgA, IgD, IgE, IgG, and IgM. These classes are also designated α, δ, ε, γ, and μ, respectively. The IgG and IgA classes are further divided into subclasses on the basis of differences in sequence and function. Humans express the following subclasses: IgG1, IgG2, IgG3, IgG4, IgA1, and IgA2.

The amino acid sequence boundaries of a CDR can be determined by one of skill in the art using any of a number of known numbering schemes, including those described by Kabat et al., supra ("Kabat" numbering scheme); Al-Lazikani et al., 1997, J. Mol. Biol., 273:927-948 ("Chothia" numbering scheme); MacCallum et al., 1996, J. Mol. Biol.

262:732-745 ("Contact" numbering scheme); Lefranc et al., *Dev. Comp. Immunol.*, 2003, 27:55-77 ("IMGT" numbering scheme); and Honegge and Plückthun, *J. Mol. Biol.*, 2001, 309:657-70 ("AHo" numbering scheme); each of which is incorporated by reference in its entirety.

Table 1 provides the positions of CDR1-L (CDR1 of $V_L$), CDR2-L (CDR2 of $V_L$), CDR3-L (CDR3 of $V_L$), CDR1-H (CDR1 of $V_H$), CDR2-H (CDR2 of $V_H$), and CDR3-H (CDR3 of $V_H$), as identified by the Kabat and Chothia schemes. For CDR1-H, residue numbering is provided using both the Kabat and Chothia numbering schemes.

CDRs may be assigned, for example, using antibody numbering software, such as Abnum, available at bioinf.org.uk/abs/abnum/, and described in Abhinandan and Martin, *Immunology*, 2008, 45:3832-3839, incorporated by reference in its entirety.

TABLE 1

Residues in CDRs according to Kabat and Chothia numbering schemes.

| CDR | Kabat | Chothia |
| --- | --- | --- |
| CDR1-L | 24-34 | 24-34 |
| CDR2-L | 50-56 | 50-56 |
| CDR3-L | 89-97 | 89-97 |
| CDR1-H (Kabat Numbering) | 31-35B | 26-32 or 34* |
| CDR1-H (Chothia Numbering) | 31-35 | 26-32 |
| CDR2-H | 50-65 | 52-56 |
| CDR3-H | 95-102 | 95-102 |

*The C-terminus of CDR1-H, when numbered using the Kabat numbering convention, varies between 32 and 34, depending on the length of the CDR.

The "EU numbering scheme" is generally used when referring to a residue in an antibody heavy chain constant region (e.g., as reported in Kabat et al., supra).

An "antibody fragment" comprises a portion of an intact antibody, such as the antigen-binding or variable region of an intact antibody. Antibody fragments include, for example, Fv fragments, Fab fragments, F(ab')$_2$ fragments, Fab' fragments, scFv (sFv) fragments, and scFv-Fc fragments.

"Fv" fragments comprise a non-covalently-linked dimer of one heavy chain variable domain and one light chain variable domain.

"Fab" fragments comprise, in addition to the heavy and light chain variable domains, the constant domain of the light chain and the first constant domain ($C_{H1}$) of the heavy chain. Fab fragments may be generated, for example, by recombinant methods or by papain digestion of a full-length antibody.

"F(ab')$_2$" fragments contain two Fab' fragments joined, near the hinge region, by disulfide bonds. F(ab')$_2$ fragments may be generated, for example, by recombinant methods or by pepsin digestion of an intact antibody. The F(ab') fragments can be dissociated, for example, by treatment with β-mercaptoethanol.

"Single-chain Fv" or "sFv" or "scFv" antibody fragments comprise a $V_H$ domain and a $V_L$ domain in a single polypeptide chain. The $V_H$ and $V_L$ are generally linked by a peptide linker. See Plückthun A. (1994). In some embodiments, the linker is a (GGGGS)$_n$ (SEQ ID NO: 5). In some embodiments, n=1, 2, 3, 4, 5, or 6. See Antibodies from *Escherichia coli*. In Rosenberg M. & Moore G. P. (Eds.), *The Pharmacology of Monoclonal Antibodies* vol. 113 (pp. 269-315). Springer-Verlag, New York, incorporated by reference in its entirety.

"scFv-Fc" fragments comprise an scFv attached to an Fc domain. For example, an Fc domain may be attached to the C-terminal of the scFv. The Fc domain may follow the $V_H$ or $V_L$, depending on the orientation of the variable domains in the scFv (i.e., $V_H$-$V_L$ or $V_L$-$V_H$). Any suitable Fc domain known in the art or described herein may be used. In some cases, the Fc domain comprises an IgG4 Fc domain.

The term "single domain antibody" refers to a molecule in which one variable domain of an antibody specifically binds to an antigen without the presence of the other variable domain. Single domain antibodies, and fragments thereof, are described in Arabi Ghahroudi et al., *FEBS Letters*, 1998, 414:521-526 and Muyldermans et al., *Trends in Biochem. Sci.*, 2001, 26:230-245, each of which is incorporated by reference in its entirety.

A "monospecific RPP" is an RPP that comprises a binding site that specifically binds to a single epitope. An example of a monospecific RPP is a naturally occurring IgG molecule which, while divalent, recognizes the same epitope at each antigen-binding domain. The binding specificity may be present in any suitable valency.

A "polyspecific RPP" is an RPP that binds to more than one epitope. An example of a polyspecific RPP is a mixture of antibodies that bind to different serotypes of pneumococcal bacteria.

The term "monoclonal antibody" refers to an antibody from a population of substantially homogeneous antibodies. A population of substantially homogeneous antibodies comprises antibodies that are substantially similar and that bind the same epitope(s), except for variants that may normally arise during production of the monoclonal antibody. Such variants are generally present in only minor amounts. A monoclonal antibody is typically obtained by a process that includes the selection of a single antibody from a plurality of antibodies. For example, the selection process can be the selection of a unique clone from a plurality of clones, such as a pool of hybridoma clones, phage clones, yeast clones, bacterial clones, or other recombinant DNA clones. The selected antibody can be further altered, for example, to improve affinity for the target ("affinity maturation"), to humanize the antibody, to improve its production in cell culture, and/or to reduce its immunogenicity in a subject.

The term "polyclonal antibody" refers to a mixture of at least two monoclonal antibodies. Polyclonal antibodies may be either monospecific or polyspecific.

The term "chimeric antibody" refers to an antibody in which a portion of the heavy and/or light chain is derived from a particular source or species, while the remainder of the heavy and/or light chain is derived from a different source or species.

"Humanized" forms of non-human antibodies are chimeric antibodies that contain minimal sequence derived from the non-human antibody. A humanized antibody is generally a human antibody (recipient antibody) in which residues from one or more CDRs are replaced by residues from one or more CDRs of a non-human antibody (donor antibody). The donor antibody can be any suitable non-human antibody, such as a mouse, rat, rabbit, chicken, or non-human primate antibody having a desired specificity, affinity, or biological effect. In some instances, selected framework region residues of the recipient antibody are replaced by the corresponding framework region residues from the donor antibody. Humanized antibodies may also comprise residues that are not found in either the recipient antibody or the donor antibody. Such modifications may be made to further refine antibody function. For further details, see Jones et al., *Nature*, 1986, 321:522-525; Riechmann et al., *Nature*, 1988, 332:323-329; and Presta, *Curr. Op. Struct. Biol.*, 1992, 2:593-596, each of which is incorporated by reference in its entirety.

A "human antibody" is one which possesses an amino acid sequence corresponding to that of an antibody produced by a human or a human cell, or derived from a non-human source that utilizes a human antibody repertoire or human antibody-encoding sequences (e.g., obtained from human sources or designed de novo). Human antibodies specifically exclude humanized antibodies.

An "isolated RPP" or "isolated nucleic acid" is an RPP or nucleic acid that has been separated and/or recovered from a component of its natural environment. Components of the natural environment may include enzymes, hormones, and other proteinaceous or nonproteinaceous materials. In some embodiments, an isolated RPP is purified to a degree sufficient to obtain at least 15 residues of N-terminal or internal amino acid sequence, for example by use of a spinning cup sequenator. In some embodiments, an isolated RPP is purified to homogeneity by gel electrophoresis (e.g., SDS-PAGE) under reducing or nonreducing conditions, with detection by Coomassie blue or silver stain. An isolated RPP includes an RPP in situ within recombinant cells, since at least one component of the RPP's natural environment is not present. In some aspects, an isolated RPP or isolated nucleic acid is prepared by at least one purification step. In some embodiments, an isolated RPP or isolated nucleic acid is purified to at least 80%, 85%, 90%, 95%, or 99% by weight. In some embodiments, an isolated RPP or isolated nucleic acid is purified to at least 80%, 85%, 90%, 95%, or 99% by volume. In some embodiments, an isolated RPP or isolated nucleic acid is provided as a solution comprising at least 85%, 90%, 95%, 98%, 99% to 100% RPP or nucleic acid by weight. In some embodiments, an isolated RPP or isolated nucleic acid is provided as a solution comprising at least 85%, 90%, 95%, 98%, 99% to 100% RPP or nucleic acid by volume.

"Affinity" refers to the strength of the sum total of non-covalent interactions between a single binding site of a molecule (e.g., an RPP) and its binding partner (e.g., an antigen or epitope). Unless indicated otherwise, as used herein, "affinity" refers to intrinsic binding affinity, which reflects a 1:1 interaction between members of a binding pair (e.g., RPP and antigen or epitope). The affinity of a molecule X for its partner Y can be represented by the dissociation equilibrium constant ($K_D$). The kinetic components that contribute to the dissociation equilibrium constant are described in more detail below. Affinity can be measured by common methods known in the art, including those described herein. Affinity can be determined, for example, using surface plasmon resonance (SPR) technology (e.g., BIACORE®) or biolayer interferometry (e.g., FORTEBIO®).

With regard to the binding of an RPP to a target molecule, the terms "bind," "specific binding," "specifically binds to," "specific for," "selectively binds," and "selective for" a particular antigen (e.g., a polypeptide target) or an epitope on a particular antigen mean binding that is measurably different from a non-specific or non-selective interaction (e.g., with a non-target molecule). Specific binding can be measured, for example, by measuring binding to a target molecule and comparing it to binding to a non-target molecule. Specific binding can also be determined by competition with a control molecule that mimics the epitope recognized on the target molecule. In that case, specific binding is indicated if the binding of the RPP to the target molecule is competitively inhibited by the control molecule.

The term "$k_d$" (sec$^{-1}$), as used herein, refers to the dissociation rate constant of a particular ABP-antigen interaction. This value is also referred to as the $k_{off}$ value.

The term "$k_a$" (M$^{-1}$×sec$^{-1}$), as used herein, refers to the association rate constant of a particular ABP-antigen interaction. This value is also referred to as the $k_{on}$ value.

The term "$K_D$" (M), as used herein, refers to the dissociation equilibrium constant of a particular ABP-antigen interaction. $K_D=k_d/k_a$.

The term "$K_A$" (M$^{-1}$), as used herein, refers to the association equilibrium constant of a particular ABP-antigen interaction. $K_A=k_a/k_d$.

An "immunoconjugate" is an RPP conjugated to one or more heterologous molecule(s).

"Effector functions" refer to those biological activities mediated by the Fc region of an antibody, which activities may vary depending on the antibody isotype. Examples of antibody effector functions include C1q binding to activate complement dependent cytotoxicity (CDC), Fc receptor binding to activate antibody-dependent cellular cytotoxicity (ADCC), and antibody dependent cellular phagocytosis (ADCP).

When used herein in the context of two or more RPPs, the term "competes with" or "cross-competes with" indicates that the two or more RPPs compete for binding to an antigen (e.g., pneumococcus polysaccharide). In one exemplary assay, an antigen is coated on a surface and contacted with a first RPP against the antigen, after which a second RPP against the antigen is added. In another exemplary assay, a first RPP against an antigen is coated on a surface and contacted with the antigen, and then a second RPP against the antigen is added. If the presence of the first RPP against an antigen reduces binding of the second RPP, in either assay, then the RPPs compete. The term "competes with" also includes combinations of RPPs where one RPP reduces binding of another RPP, but where no competition is observed when the RPPs are added in the reverse order. However, in some embodiments, the first and second RPPs inhibit binding of each other, regardless of the order in which they are added. In some embodiments, one RPP reduces binding of another RPP to its antigen by at least 25%, at least 50%, at least 60%, at least 70%, at least 80%, at least 85%, at least 90%, or at least 95%. A skilled artisan can select the concentrations of the antibodies used in the competition assays based on the affinities of the RPPs for pneumococcus polysaccharide and the valency of the RPPs. The assays described in this definition are illustrative, and a skilled artisan can utilize any suitable assay to determine if antibodies compete with each other. Suitable assays are described, for example, in Cox et al., "Immunoassay Methods," in *Assay Guidance Manual* [*Internet*], Updated Dec. 24, 2014 ncbi.nlm.nih.gov/books/NBK92434/; accessed Sep. 29, 2015); Silman et al., *Cytometry*, 2001, 44:30-37; and Finco et al., *J. Pharm. Biomed. Anal.*, 2011, 54:351-358; each of which is incorporated by reference in its entirety.

The term "epitope" means a portion of an antigen the specifically binds to an RPP or an ABP. Epitopes frequently consist of surface-accessible amino acid residues and/or sugar side chains and may have specific three-dimensional structural characteristics, as well as specific charge characteristics. Conformational and non-conformational epitopes are distinguished in that the binding to the former but not the latter may be lost in the presence of denaturing solvents. An epitope may comprise amino acid residues that are directly involved in the binding, and other amino acid residues, which are not directly involved in the binding. The epitope to which an RPP or an ABP binds can be determined using known techniques for epitope determination such as, for example, testing for RPP or an ABP binding to an antigen.

Percent "identity" between a polypeptide sequence and a reference sequence, is defined as the percentage of amino acid residues in the polypeptide sequence that are identical to the amino acid residues in the reference sequence, after aligning the sequences and introducing gaps, if necessary, to achieve the maximum percent sequence identity. Alignment for purposes of determining percent amino acid sequence identity can be achieved in various ways that are within the skill in the art, for instance, using publicly available computer software such as BLAST, BLAST-2, ALIGN, MEGA-LIGN (DNASTAR), CLUSTALW, CLUSTAL OMEGA, or MUSCLE software. Those skilled in the art can determine appropriate parameters for aligning sequences, including any algorithms needed to achieve maximal alignment over the full length of the sequences being compared.

A "conservative substitution" or a "conservative amino acid substitution," refers to the substitution an amino acid with a chemically or functionally similar amino acid. Conservative substitution tables providing similar amino acids are well known in the art. By way of example, the groups of amino acids provided in TABLES 2-4 are, in some embodiments, considered conservative substitutions for one another.

TABLE 2

Selected groups of amino acids that are considered conservative substitutions for one another, in certain embodiments.

| | |
|---|---|
| Acidic Residues | D and E |
| Basic Residues | K, R, and H |
| Hydrophilic Uncharged Residues | S, T, N, and Q |
| Aliphatic Uncharged Residues | G, A, V, L, and I |
| Non-polar Uncharged Residues | C, M, and P |
| Aromatic Residues | F, Y, and W |

TABLE 3

Additional selected groups of amino acids that are considered conservative substitutions for one another, in certain embodiments.

| | |
|---|---|
| Group 1 | A, S, and T |
| Group 2 | D and E |
| Group 3 | N and Q |
| Group 4 | R and K |
| Group 5 | I, L, and M |
| Group 6 | F, Y, and W |

TABLE 4

Further selected groups of amino acids that are considered conservative substitutions for one another, in certain embodiments.

| | |
|---|---|
| Group A | A and G |
| Group B | D and E |
| Group C | N and Q |
| Group D | R, K, and H |
| Group E | I, L, M, V |
| Group F | F, Y, and W |
| Group G | S and T |
| Group H | C and M |

Additional conservative substitutions may be found, for example, in Creighton, *Proteins: Structures and Molecular Properties* 2nd ed. (1993) W. H. Freeman & Co., New York, N.Y. An RPP generated by making one or more conservative substitutions of amino acid residues in a parent RPP is referred to as a "conservatively modified variant."

The term "treating" (and variations thereof such as "treat" or "treatment") refers to clinical intervention in an attempt to alter the natural course of a disease or condition in a subject in need thereof. Treatment can be performed both for prophylaxis and during the course of clinical pathology. Desirable effects of treatment include preventing occurrence or recurrence of disease, alleviation of symptoms, diminish of any direct or indirect pathological consequences of the disease, preventing reinfection or associated symptom, decreasing the rate of disease progression, amelioration or palliation of the disease state, and remission or improved prognosis. Improvements in any conditions can be readily assessed according to standard methods and techniques known in the art. The population of subjects treated by the method of the disease includes subjects suffering from the undesirable condition or disease, as well as subjects at risk for development of the condition or disease.

As used herein, the term "therapeutically effective amount" or "effective amount" refers to an amount of an RPP or pharmaceutical composition provided herein that, when administered to a subject, is effective to produces the desired effect for which it is administered. The exact dose or amount will depend on the purpose of the treatment, and will be ascertainable by one skilled in the art using known techniques (see, e.g., Lloyd (1999) The Art, Science and Technology of Pharmaceutical Compounding). A therapeutically effective amount can be a "prophylactically effective amount" as prophylaxis can be considered therapy. The term "sufficient amount" means an amount sufficient to produce a desired effect.

As used herein, the term "subject" means a mammalian subject. Exemplary subjects include humans, monkeys, dogs, cats, mice, rats, cows, horses, camels, goats, rabbits, and sheep. In certain embodiments, the subject is a human. In some embodiments the subject has a disease or condition that can be treated with an RPP provided herein. In some aspects, the disease or condition is a cancer. In some aspects, the disease or condition is a viral infection.

The term "package insert" is used to refer to instructions customarily included in commercial packages of therapeutic or diagnostic products (e.g., kits) that contain information about the indications, usage, dosage, administration, combination therapy, contraindications and/or warnings concerning the use of such therapeutic or diagnostic products.

The term "pharmaceutical composition" refers to a preparation which is in such form as to permit the biological activity of an active ingredient contained therein to be effective in treating a subject, and which contains no additional components which are unacceptably toxic to the subject.

The term "plasma cell" refers to white blood cells that secrete large volumes of antibodies. They are transported by the blood plasma and the lymphatic system. B cells (for example, either germinal center naïve B cells or memory B cells) differentiate into plasma cells that produce antibody molecules closely modelled after the receptors of the precursor B cell. Once released into the blood and lymph, these antibody molecules bind to the target antigen (foreign substance) and initiate its neutralization or destruction. Terminally differentiated plasma cells express relatively few surface antigens, and do not express common pan-B cell markers, such as CD19 and CD20. Instead, plasma cells are identified through flow cytometry by their additional expression of CD138, CD78, and the Interleukin-6 receptor. In humans, CD27 is a good marker for plasma cells, naive B cells are CD27−, memory B-cells are CD27+ and plasma cells are CD27++. The surface antigen CD138 (syndecan-1) is expressed at high levels. Another important surface antigen is CD319 (SLAMF7). This antigen is expressed at high levels on normal human plasma cells. It is also expressed on malignant plasma cells in multiple myeloma. Compared with CD138, which disappears rapidly ex vivo, the expression of CD319 is considerably more stable.

The term "plasmablast" refers to antibody-secreting cells in the peripheral blood, which differentiate from activated B cells, such as memory B cells, upon stimulation with an antigen. The most immature blood cell that is considered of plasma cell lineage is the plasmablast. Plasmablasts secrete more antibodies than B cells, but less than plasma cells. They divide rapidly and are still capable of internalizing antigens and presenting them to T cells. A cell may stay in this state for several days, and then either die or irrevocably differentiate into a mature, fully differentiated plasma cell. Differentiation of mature B cells into plasma cells is dependent upon the transcription factors Blimp-1/PRDM1 and IRF4.

The term "memory B cell" refers to a B cell sub-type that are formed within germinal centers following primary infection and are important in generating an accelerated and more robust antibody-mediated immune response in the case of re-infection (also known as a secondary immune response). Memory B cells do not secrete antibody until activated by their specific antigen.

The term "naïve B cell" refers to a B cell that has not been exposed to an antigen. Once exposed to an antigen, the naïve B cell either becomes a memory B cell or a plasma cell that secretes antibodies specific to the antigen that was originally bound. Plasma cells do not last long in the circulation, this is in contrast to memory cells that last for very long periods of time.

The term "peripheral blood" refers to blood which travels through peripheral vessels. Peripheral blood is typically obtained by venipuncture (also called phlebotomy), or by finger prick for small quantities.

The term "plasma hyperimmune" refers to a polyclonal antibody preparation similar to intravenous immunoglobulin (IVIg), except that it is prepared from the plasma of donors with high titers of antibody against a specific organism or antigen. The term hyperimmune is often used interchangeably with the terms "hyperimmune gammaglobulin" and "hyperimmune globulin". Some agents against which hyperimmune globulins are available include hepatitis B, rabies, tetanus toxin, varicella-zoster, etc. Administration of hyperimmune globulin provides "passive" immunity to the patient against an agent. This is in contrast to vaccines that provide "active" immunity. However, vaccines take much longer to achieve that purpose while hyperimmune globulin provides instant "passive" short-lived immunity.

The term "activity" refers to a quantitative measurement of an RPP or antibody against an antigen, vaccine, protein, epitope, cell, bacterium, or virus. Activity can be assessed using in vivo or in vitro methods.

The term "recombinant" refers to proteins that result from the expression of recombinant DNA within living cells. Recombinant DNA is the general name for a piece of DNA that has been created by the combination of at least two separate segments of DNA.

The term "neutralization" refers to the ability of specific antibodies to block the site(s) on viruses that they use to enter their target cell. The effect of a neutralizing antibody can be negligible even with large excesses of antibody production if they lack specificity to this antigen. The production of specific antibodies can be learned for a faster response at next exposition. The reduction or destruction of a homologous infectious agent can be partial or complete and can make it no longer infectious or pathogenic to other cells.

A "variant" of a polypeptide (e.g., an antibody) comprises an amino acid sequence wherein one or more amino acid residues are inserted into, deleted from and/or substituted into the amino acid sequence relative to the native polypeptide sequence, and retains essentially the same biological activity as the native polypeptide. The biological activity of the polypeptide can be measured using standard techniques in the art (for example, if the variant is an antibody, its activity may be tested by binding assays, as described herein). Variants of the invention include fragments, analogs, recombinant polypeptides, synthetic polypeptides, and/or fusion proteins.

A "derivative" of a polypeptide is a polypeptide (e.g., an antibody) that has been chemically modified, e.g., via conjugation to another chemical moiety such as, for example, polyethylene glycol, albumin (e.g., human serum albumin), phosphorylation, and glycosylation. Unless otherwise indicated, the term "antibody" includes, in addition to antibodies comprising two full-length heavy chains and two full-length light chains, derivatives, variants, fragments, and muteins thereof, examples of which are described below.

A nucleotide sequence is "operably linked" to a regulatory sequence if the regulatory sequence affects the expression (e.g., the level, timing, or location of expression) of the nucleotide sequence. A "regulatory sequence" is a nucleic acid that affects the expression (e.g., the level, timing, or location of expression) of a nucleic acid to which it is operably linked. The regulatory sequence can, for example, exert its effects directly on the regulated nucleic acid, or through the action of one or more other molecules (e.g., polypeptides that bind to the regulatory sequence and/or the nucleic acid). Examples of regulatory sequences include promoters, enhancers and other expression control elements (e.g., polyadenylation signals). Further examples of regulatory sequences are described in, for example, Goeddel, 1990, Gene Expression Technology: Methods in Enzymology 185, Academic Press, San Diego, Calif. and Baron et al., 1995, Nucleic Acids Res. 23:3605-06.

A "host cell" is a cell that can be used to express a nucleic acid, e.g., a nucleic acid of the invention. A host cell can be a prokaryote, for example, *E. coli*, or it can be a eukaryote, for example, a single-celled eukaryote (e.g., a yeast or other fungus), a plant cell (e.g., a tobacco or tomato plant cell), an animal cell (e.g., a human cell, a monkey cell, a hamster cell, a rat cell, a mouse cell, or an insect cell) or a hybridoma. Examples of host cells include CS-9 cells, the COS-7 line of monkey kidney cells (ATCC CRL 1651) (see Gluzman et al., 1981, Cell 23:175), L cells, C127 cells, 3T3 cells (ATCC CCL 163), Chinese hamster ovary (CHO) cells or their derivatives such as Veggie CHO and related cell lines which grow in serum-free media (see Rasmussen et al., 1998, Cytotechnology 28:31), HeLa cells, BHK (ATCC CRL 10) cell lines, the CV1/EBNA cell line derived from the African green monkey kidney cell line CV1 (ATCC CCL 70) (see McMahan et al., 1991, EMBO J. 10:2821), human embryonic kidney cells such as 293, 293 EBNA or MSR 293, human epidermal A431 cells, human Colo205 cells, other transformed primate cell lines, normal diploid cells, cell strains derived from in vitro culture of primary tissue, primary explants, HL-60, U937, HaK or Jurkat cells. Typically, a host cell is a cultured cell that can be transformed or transfected with a polypeptide-encoding nucleic acid, which can then be expressed in the host cell.

The phrase "recombinant host cell" can be used to denote a host cell that has been transformed or transfected with a nucleic acid to be expressed. A host cell also can be a cell that comprises the nucleic acid but does not express it at a desired level unless a regulatory sequence is introduced into the host cell such that it becomes operably linked with the nucleic acid. It is understood that the term host cell refers not only to the particular subject cell but to the progeny or potential progeny of such a cell. Because certain modifications may occur in succeeding generations due to, e.g., mutation or environmental influence, such progeny may not, in fact, be identical to the parent cell, but are still included within the scope of the term as used herein.

Other Interpretational Conventions

Ranges recited herein are understood to be shorthand for all of the values within the range, inclusive of the recited endpoints. For example, a range of 1 to 50 is understood to include any number, combination of numbers, or sub-range from the group consisting of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50.

Unless otherwise indicated, reference to a compound that has one or more stereocenters intends each stereoisomer, and all combinations of stereoisomers, thereof.

Recombinant Polyclonal Protein (RPP)

The present disclosure provides a RPP that specifically binds a SARS-CoV-2 antigen. The RPP comprises a plurality of ABPs specifically binding to one or more SARS-CoV-2 antigens. The SARS-CoV-2 antigen can be a SARS-CoV-2 receptor binding domain (RBD), SARS-CoV-2 spike S1, or other protein specific to SARS-CoV-2.

In some embodiments, the RPP binds an aitngen, wherein a. the antigen is a SARS-CoV-2 receptor binding domain (RBD) and the library comprises at least 100 RPPs each with a cognate pair of heavy chain CDR3 and light chain CDR3 sequences as shown in Table 5, optionally all the cognate pairs; orb. the antigen is a SARS-CoV-2 spike S1 and the library comprises at least 100 RPPs each with a cognate pair of heavy chain CDR3 and light chain CDR3 sequences as shown in Table 5, optionally all the cognate pairs; or c. a combination of a and b.

In some embodiments, the RPP comprises scFvs. In some embodiments, the RPP consists of scFvs. In some embodiments, the RPP comprises antibody fragments. In some embodiments, the RPP consists of antibody fragments. In some embodiments, the RPP comprises recombinant full-length antibodies. In some embodiments, the RPP consists of recombinant full-length antibodies. In some embodiments, the RPP comprises human antibodies. In some embodiments, the RPP comprises humanized antibodies. In some embodiments, the RPP comprises monospecific ABPs. In some embodiments, the RPP comprises bispecific ABPs. In some embodiments, the RPP consists of ABPs of a human IgG1 subtype.

In some embodiments, the RPP comprises antibody fragments. The RPP can be a Fab fragment, a F(ab')$_2$ fragment an Fv fragment, or a combination thereof. A Fab fragment is a monovalent fragment having the $V_L$, $V_H$, $C_L$ and $C_{H1}$ domains; a F(ab')$_2$ fragment is a bivalent fragment having two Fab fragments linked by a disulfide bridge at the hinge region; a Fd fragment has the $V_H$ and $C_{H1}$ domains; an Fv fragment has the $V_L$ and $V_H$ domains of a single arm of an antibody; and a dAb fragment has a $V_H$ domain, a $V_L$ domain, or an antigen-binding fragment of a $V_H$ or $V_L$ domain (U.S. Pat. Nos. 6,846,634, 6,696,245, US App. Pub. No. 05/0202512, 04/0202995, 04/0038291, 04/0009507, 03/0039958, Ward et al., Nature 341:544-546, 1989).

Naturally occurring immunoglobulin chains exhibit the same general structure of relatively conserved framework regions (FR) joined by three hypervariable regions, also called complementarity determining regions or CDRs. From N-terminus to C-terminus, both light and heavy chains comprise the domains FR1, CDR1, FR2, CDR2, FR3, CDR3 and FR4. The assignment of amino acids to each domain is in accordance with the definitions of Kabat et al. in Sequences of Proteins of Immunological Interest, 5th Ed., US Dept. of Health and Human Services, PHS, NIH, NIH Publication no. 91-3242, 1991.

In some embodiments, the RPP is humanized antibodies. A humanized antibody has a sequence that differs from the sequence of an antibody derived from a non-human species by one or more amino acid substitutions, deletions, and/or additions, such that the humanized antibody is less likely to induce an immune response, and/or induces a less severe immune response, as compared to the non-human species antibody, when it is administered to a human subject. In one embodiment, certain amino acids in the framework and constant domains of the heavy and/or light chains of the non-human species antibody are mutated to produce the humanized antibody. In another embodiment, the constant domain(s) from a human antibody are fused to the variable domain(s) of a non-human species. In another embodiment, one or more amino acid residues in one or more CDR sequences of a non-human antibody are changed to reduce the likely immunogenicity of the non-human antibody when it is administered to a human subject, wherein the changed amino acid residues either are not critical for immunospecific binding of the antibody to its antigen, or the changes to the amino acid sequence that are made are conservative changes, such that the binding of the humanized antibody to the antigen is not significantly worse than the binding of the non-human antibody to the antigen. Examples of how to make humanized antibodies may be found in U.S. Pat. Nos. 6,054,297, 5,886,152 and 5,877,293.

Fragments or analogs of antibodies can be readily prepared by those of ordinary skill in the art following the teachings of this specification and using techniques well-known in the art. Preferred amino- and carboxy-termini of fragments or analogs occur near boundaries of functional domains. Structural and functional domains can be identified by comparison of the nucleotide and/or amino acid sequence data to public or proprietary sequence databases. Computerized comparison methods can be used to identify sequence motifs or predicted protein conformation domains that occur in other proteins of known structure and/or function. Methods to identify protein sequences that fold into a known three-dimensional structure are known. See, e.g., Bowie et al., 1991, Science 253:164.

An RPP can also be any synthetic or genetically engineered protein. For example, antibody fragments include isolated fragments consisting of the light chain variable region, "Fv" fragments consisting of the variable regions of the heavy and light chains, recombinant single chain polypeptide molecules in which light and heavy variable regions are connected by a peptide linker (scFv proteins).

Another form of an antibody fragment is a peptide comprising one or more complementarity determining regions (CDRs) of an antibody. CDRs (also termed "minimal recognition units", or "hypervariable region") can be incorporated into a molecule either covalently or noncovalently to make it an antigen binding protein. CDRs can be obtained by constructing polynucleotides that encode the CDR of interest. Such polynucleotides are prepared, for example, by using the polymerase chain reaction to synthesize the variable region using mRNA of antibody producing cells as a template (see, for example, Larrick et al., Methods: A Companion to Methods in Enzymology 2:106, 1991; Courtenay Luck, "Genetic Manipulation of Monoclonal Antibodies," in Monoclonal Antibodies: Production, Engineering and Clinical Application, Ritter et al. (eds.), page 166 (Cambridge University Press 1995); and Ward et al., "Genetic Manipulation and Expression of Antibodies," in Monoclonal Antibodies: Principles and Applications, Birch et al., (eds.), page 137 (Wiley Liss, Inc. 1995).

The variable region domains of RPPs can be any naturally occurring variable domain or an engineered version thereof. By engineered version is meant a variable region domain that has been created using recombinant DNA engineering techniques. Such engineered versions include those created, for example, from a specific antibody variable region by insertions, deletions, or changes in or to the amino acid sequences of the specific antibody. Particular examples include engineered variable region domains containing at least one CDR and optionally one or more framework amino acids from a first antibody and the remainder of the variable region domain from a second antibody.

The variable region domain may be covalently attached at a C terminal amino acid to at least one other antibody domain or a fragment thereof. Thus, for example, a $V_H$ domain that is present in the variable region domain may be linked to an immunoglobulin CH1 domain, or a fragment thereof. Similarly, a $V_L$ domain may be linked to a CK domain or a fragment thereof. In this way, for example, the antibody may be a Fab fragment wherein the antigen binding domain contains associated $V_H$ and $V_L$ domains covalently linked at their C termini to a CH1 and CK domain, respectively. The CH1 domain may be extended with further amino acids, for example to provide a hinge region or a portion of a hinge region domain as found in a Fab' fragment, or to provide further domains, such as antibody CH2 and CH3 domains.

The RPP can be ABPs comprising, e.g., the cognate pairs of heavy and light chain CDR3 sequence disclosed herein. For example, CDRs may be incorporated into known antibody framework regions (IgG1, IgG2, etc.), or conjugated to a suitable vehicle to enhance the half-life thereof. Suitable vehicles include, but are not limited to, Fc, polyethylene glycol (PEG), albumin, transferrin, and the like. These and other suitable vehicles are known in the art. Such conjugated CDR peptides may be in monomeric, dimeric, tetrameric, or other form. In one embodiment, one or more water-soluble polymer is bonded at one or more specific position, for example at the amino terminus, of a binding agent.

In certain embodiments, the RPP comprises one or more water soluble polymer attachments, including, but not limited to, polyethylene glycol, polyoxyethylene glycol, or polypropylene glycol. See, e.g., U.S. Pat. Nos. 4,640,835, 4,496,689, 4,301,144, 4,670,417, 4,791,192 and 4,179,337. In certain embodiments, a derivative binding agent comprises one or more of monomethoxy-polyethylene glycol, dextran, cellulose, or other carbohydrate based polymers, poly-(N-vinyl pyrrolidone)-polyethylene glycol, propylene glycol homopolymers, a polypropylene oxide/ethylene oxide co-polymer, polyoxyethylated polyols (e.g., glycerol) and polyvinyl alcohol, as well as mixtures of such polymers. In certain embodiments, one or more water-soluble polymer is randomly attached to one or more side chains. In certain embodiments, PEG can act to improve the therapeutic capacity for a binding agent, such as an antibody. Certain such methods are discussed, for example, in U.S. Pat. No. 6,133,426, which is hereby incorporated by reference for any purpose.

An RPP can have, for example, the structure of a naturally occurring immunoglobulin. An "immunoglobulin" is a tetrameric molecule. In a naturally occurring immunoglobulin, each tetramer is composed of two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of each chain defines a constant region primarily responsible for effector function. Human light chains are classified as kappa and lambda light chains. Heavy chains are classified as mu, delta, gamma, alpha, or epsilon, and define the antibody's isotype as IgM, IgD, IgG, IgA, and IgE, respectively. Within light and heavy chains, the variable and constant regions are joined by a "J" region of about 12 or more amino acids, with the heavy chain also including a "D" region of about 10 more amino acids. See generally, Fundamental Immunology Ch. 7 (Paul, W., ed., 2nd ed. Raven Press, N.Y. (1989)) (incorporated by reference in its entirety for all purposes). The variable regions of each light/heavy chain pair form the antibody binding site such that an intact immunoglobulin has two binding sites.

Different RPPs may bind to different domains of disease targets or act by different mechanisms of action. As indicated herein inter alia, the domain regions are designated such as to be inclusive of the group, unless otherwise indicated. For example, amino acids 4-12 refers to nine amino acids: amino acids at positions 4, and 12, as well as the seven intervening amino acids in the sequence. Other examples include antigen binding proteins that inhibit binding of a pathogen to its target cell, i.e., neutralizing activity. An antigen binding protein need not completely inhibit a binding to target cell to find use in the present invention.

The RPPs describe herein can include an Fc region, e.g., a dimer Fc polypeptide. One suitable Fc polypeptide, described in PCT application WO 93/10151 (hereby incorporated by reference), is a single chain polypeptide extending from the N-terminal hinge region to the native C-terminus of the Fc region of a human IgG1 antibody. Another useful Fc polypeptide is the Fc mutein described in U.S. Pat. No. 5,457,035 and in Baum et al., 1994, EMBO J. 13:3992-4001. The amino acid sequence of this mutein is identical to that of the native Fc sequence presented in WO 93/10151, except that amino acid 19 has been changed from Leu to Ala, amino acid 20 has been changed from Leu to Glu, and amino acid 22 has been changed from Gly to Ala. The mutein exhibits reduced affinity for Fc receptors.

Antigen-binding fragments of RPPs of the invention can be produced by conventional techniques. Examples of such fragments include, but are not limited to, Fab and F(ab')$_2$ fragments. Antibody fragments and derivatives produced by genetic engineering techniques also are contemplated.

Additional embodiments include chimeric antibodies, e.g., humanized versions of non-human (e.g., murine) monoclonal antibodies. Such humanized antibodies may be prepared by known techniques, and offer the advantage of reduced immunogenicity when the antibodies are administered to humans. In one embodiment, a humanized antibody comprises the variable domain of a murine antibody (or all or part of the antigen binding site thereof) and a constant domain derived from a human antibody. Alternatively, a humanized antibody fragment may comprise the antigen binding site of a murine antibody and a variable domain fragment (lacking the antigen-binding site) derived from a human antibody. Procedures for the production of chimeric and further engineered antibodies include those described in Riechmann et al., 1988, Nature 332:323, Liu et al., 1987, Proc. Nat. Acad. Sci. USA 84:3439, Larrick et al., 1989, Bio/Technology 7:934, and Winter et al., 1993, TIPS 14:139. In one embodiment, the chimeric antibody is a CDR grafted antibody. Techniques for humanizing antibodies are discussed in, e.g., U.S. Pat. Nos. 5,869,619, 5,225,539, 5,821,337, 5,859,205, 6,881,557, Padlan et al., 1995, FASEB J. 9:133-39, and Tamura et al., 2000, J. Immunol. 164:1432-41.

Procedures have been developed for generating human or partially human antibodies in non-human animals. For example, mice in which one or more endogenous immunoglobulin genes have been inactivated by various means have been prepared. Human immunoglobulin genes have been introduced into the mice to replace the inactivated mouse genes. Antibodies produced in the animal incorporate human immunoglobulin polypeptide chains encoded by the human genetic material introduced into the animal. In one embodiment, a non-human animal, such as a transgenic mouse, is immunized with a vaccine, such that antibodies directed against the vaccine antigen pare generated in the animal.

Examples of techniques for production and use of transgenic animals for the production of human or partially human antibodies are described in U.S. Pat. Nos. 5,814,318, 5,569,825, and 5,545,806, Davis et al., 2003, Production of human antibodies from transgenic mice in Lo, ed. Antibody Engineering: Methods and Protocols, Humana Press, NJ:191-200, Kellermann et al., 2002, *Curr Opin Biotechnol.* 13:593-97, Russel et al., 2000, *Infect Immun.* 68:1820-26, Gallo et al., 2000, *Eur J Immun.* 30:534-40, Davis et al., 1999, *Cancer Metastasis Rev.* 18:421-25, Green, 1999, *J Immunol Methods.* 231:11-23, Jakobovits, 1998, *Advanced Drug Delivery Reviews* 31:33-42, Green et al., 1998, *J Exp Med.* 188:483-95, Jakobovits A, 1998, *Exp. Opin. Invest. Drugs.* 7:607-14, Tsuda et al., 1997, *Genomics.* 42:413-21, Mendez et al., 1997, *Nat Genet.* 15:146-56, Jakobovits, 1994, *Curr Biol.* 4:761-63, Arbones et al., 1994, *Immunity.* 1:247-60, Green et al., 1994, *Nat Genet.* 7:13-21, Jakobovits et al., 1993, *Nature.* 362:255-58, Jakobovits et al., 1993, *Proc Natl Acad Sci* USA. 90:2551-55. Chen, J., M. Trounstine, F. W. Alt, F. Young, C. Kurahara, J. Loring, D. Huszar. *Inter'l Immunol.* 5 (1993): 647-656, Choi et al., 1993, *Nature Genetics* 4: 117-23, Fishwild et al., 1996, *Nature Biotech.* 14: 845-51, Harding et al., 1995, Annals of the New York Academy of Sciences, Lonberg et al., 1994, *Nature* 368: 856-59, Lonberg, 1994, Transgenic Approaches to Human Monoclonal Antibodies in Handbook of Experimental Pharmacology 113: 49-101, Lonberg et al., 1995, Internal Review of Immunology 13: 65-93, Neuberger, 1996, *Nature Biotechnology* 14: 826, Taylor et al., 1992, *Nucleic Acids Res.* 20: 6287-95, Taylor et al., 1994, *Inter'l Immunol.* 6: 579-91, Tomizuka et al., 1997, *Nature Genetics* 16: 133-43, Tomizuka et al., 2000, *Pro. Nat'l Acad. Sci.* USA 97: 722-27, Tuaillon et al., 1993, *Pro. Nat'l Acad. Sci.* USA 90: 3720-24, and Tuaillon et al., 1994, *J. Immunol.* 152: 2912-20.

RPPs of the invention can comprise any constant region known in the art. The light chain constant region can be, for example, a kappa- or lambda-type light chain constant region, e.g., a human kappa- or lambda-type light chain constant region. The heavy chain constant region can be, for example, an alpha-, delta-, epsilon-, gamma-, or mu-type heavy chain constant regions, e.g., a human alpha-, delta-, epsilon-, gamma-, or mu-type heavy chain constant region. In one embodiment, the light or heavy chain constant region is a fragment, derivative, variant, or mutein of a naturally occurring constant region.

Techniques are known for deriving an antibody of a different subclass or isotype from an antibody of interest, i.e., subclass switching. Thus, IgG antibodies may be derived from an IgM antibody, for example, and vice versa. Such techniques allow the preparation of new antibodies that possess the antigen-binding properties of a given antibody (the parent antibody), but also exhibit biological properties associated with an antibody isotype or subclass different from that of the parent antibody. Recombinant DNA techniques may be employed. Cloned DNA encoding particular antibody polypeptides may be employed in such procedures, e.g., DNA encoding the constant domain of an antibody of the desired isotype. See also Lantto et al., 2002, *Methods Mol. Biol.* 178:303-16.

Single chain antibodies (scFv) may be formed by linking heavy and light chain variable domain (Fv region) fragments via an amino acid bridge (short peptide linker, e.g., a synthetic sequence of amino acid residues), resulting in a single polypeptide chain. Such single-chain Fvs (scFvs) have been prepared by fusing DNA encoding a peptide linker between DNAs encoding the two variable domain polypeptides ($V_L$ and $V_H$). The resulting polypeptides can fold back on themselves to form antigen-binding monomers, or they can form multimers (e.g., dimers, trimers, or tetramers), depending on the length of a flexible linker between the two variable domains (Kortt et al., 1997, *Prot. Eng.* 10:423; Kortt et al., 2001, *Biomol. Eng.* 18:95-108, Bird et al., 1988, *Science* 242:423-26 and Huston et al., 1988, *Proc. Natl. Acad. Sci.* USA 85:5879-83). By combining different $V_L$ and $V_H$-comprising polypeptides, one can form multimeric scFvs that bind to different epitopes (Kriangkum et al., 2001, *Biomol. Eng.* 18:31-40). Techniques developed for the production of single chain antibodies include those described in U.S. Pat. No. 4,946,778; Bird, 1988, *Science* 242:423; Huston et al., 1988, *Proc. Natl. Acad. Sci.* USA 85:5879; Ward et al., 1989, *Nature* 334:544, de Graaf et al., 2002, *Methods Mol Biol.* 178:379-87.

An RPP, e.g., ABPs, according to the invention may have a binding affinity for antigen target of less than or equal to $5 \times 10^{-7}$M, less than or equal to $1 \times 10^{-7}$M, less than or equal to $0.5 \times 10^{-7}$M, less than or equal to $1 \times 10^{-8}$M, less than or equal to $1 \times 10^{-9}$M, less than or equal to $1 \times 10^{-10}$M, less than or equal to $1 \times 10^{-11}$M, or less than or equal to $1 \times 10^{-12}$M.

The affinity of an RPP, as well as the extent to which the RPP inhibits binding, can be determined by one of ordinary skill in the art using conventional techniques, for example those described by Scatchard et al. (*Ann. N.Y. Acad. Sci.* 51:660-672 (1949)) or by surface plasmon resonance (SPR; BIAcore, Biosensor, Piscataway, N.J.). For surface plasmon resonance, target molecules are immobilized on a solid phase and exposed to ligands in a mobile phase running along a flow cell. If ligand binding to the immobilized target occurs, the local refractive index changes, leading to a change in SPR angle, which can be monitored in real time by detecting changes in the intensity of the reflected light. The rates of change of the SPR signal can be analyzed to yield apparent rate constants for the association and dissociation phases of the binding reaction. The ratio of these values gives the apparent equilibrium constant (affinity) (see, e.g., Wolff et al., *Cancer Res.* 53:2560-65 (1993)).

Sequences of RPP

CDR3H (heavy chain immunoglobulin) and CDR3L (light chain immunoglobulin) polypeptide sequences of recombinant antibodies generated using the methods described herein are provided in the sequence listing. A summary of the sequences is provided in TABLE 5. ABPs of the RPP provided herein can comprise a cognate pair of heavy chain CDR3 and light chain CDR3 sequences as shown in Table 5, optionally all the cognate pairs.

In some embodiments, the RPP specifically binds to a SARS-CoV-2 receptor binding domain (RBD) and comprises ABPs each with a cognate pair of heavy chain CDR3 and light chain CDR3 sequences as shown in Table 5, optionally all the cognate pairs. In particular, the heavy chain CDR3 can comprise a sequence selected from SEQ ID NO: 2, 4, 6, through 4760 (even numbers) or SEQ ID NO: 5084, 5086, 5088, through 6630 (even numbers). The light chain CDR3 can comprise a sequence selected from SEQ ID NO: 1, 3, 5, through 4759 (odd numbers) or SEQ ID NO: 5083, 5085, 5087, through 6629 (odd numbers).

In some embodiments, the RPP specifically binds to SARS-CoV-2 spike S1 and comprises ABPs each with a cognate pair of heavy chain CDR3 and light chain CDR3 sequences as shown in Table 5, optionally all the cognate pairs. In particular the heavy chain CDRs can comprise a sequence selected from SEQ ID NO: 4762, 4764, 4766, through 5082 (even numbers) or SEQ ID NO: 6632, 6634, 6636, through 8390 (even numbers). The light chain CDR3 can comprise a sequence selected from 4761, 4763, 4765, through 5081 (odd numbers) or 6631, 6633, 6635, through 8389 (odd numbers).

In some embodiments, the RPP is recombinantly produced using sequences derived from plasma cells or plasmablasts from at least one donor injected with the antigen or infected with SARS CoV-2. In some embodiments, the RPP is recombinantly produced using sequences derived from plasma cells or plasmablasts from at least one donor injected with the antigen or infected with SARS CoV-2. and the activity of the library of RPPs exceeds by at least tenfold a serum titer activity of the donor against the antigen. In some embodiments, the activity is measured by an in vitro pathogen neutralization assay or an in vitro binding to antigen assay or an in vivo efficacy assay.

In some embodiments, the RPP includes an ABP comprising cognate pairs of the heavy and light chain variable regions. In some embodiments, the ABP comprises CDR3 sequences disclosed herein. In some embodiments, the ABP comprises a heavy chain CDR3 having a sequence selected from SEQ ID Nos: 2, 4, 6, through 8390 (even numbers) and a light chain CDR3 has a sequence selected from SEQ ID Nos: 1, 3, 5, through 8389 (odd numbers). In some embodiments, the ABP comprises a heavy chain CDR3 having a sequence selected from SEQ ID Nos: 2, 4, 6, through 4760 (even numbers) and a light chain CDR3 has a sequence selected from SEQ ID Nos: 1, 3, 5, through 4759 (odd numbers). In some embodiments, the ABP comprises a heavy chain CDR3 having a sequence selected from SEQ ID Nos: 4762, 4764, 4766, through 5082 (even numbers) and a light chain CDR3 has a sequence selected from SEQ ID Nos: 4761, 4763, 4765, through 5081 (odd numbers). In some embodiments, the ABP comprises a heavy chain CDR3 having a sequence selected from SEQ ID Nos: 5084, 5086, 5088, through 6630 (even numbers) and a light chain CDR3 has a sequence selected from SEQ ID Nos: 5083, 5085, 5087, through 6629 (odd numbers). In some embodiments, the ABP comprises a heavy chain CDR3 having a sequence selected from SEQ ID Nos: 6632, 6634, 6636, through 8390 (even numbers) and a light chain CDR3 has a sequence selected from SEQ ID Nos: 6631, 6633, 6635, through 8389 (odd numbers). In some embodiments, the ABP comprises a heavy chain CDR3 having a sequence selected from SEQ ID Nos: 2, 4, 6, through 5082 (even numbers) and a light chain CDR3 has a sequence selected from SEQ ID Nos: 1, 3, 5, through 5081 (odd numbers).

In some embodiments, the ABP comprises a heavy chain CDR3 having the sequence of SEQ ID NO: [n+1] and a light chain CDR3 has the sequence of SEQ ID NO: [n], wherein n is an odd number from 1 to 8389. In some embodiments, the ABP comprises a heavy chain CDR3 having the sequence of SEQ ID NO: [n+1] and a light chain CDR3 has the sequence of SEQ ID NO: [n], wherein n is an odd number from 1 to 4759. In some embodiments, the ABP comprises a heavy chain CDR3 having the sequence of SEQ ID NO: [n+1] and a light chain CDR3 has the sequence of

TABLE 5

CDR3 heavy and CDR3 light chain sequences

| SEQ ID NO. | Description |
| --- | --- |
| 1, 3, 5, through 4759 (odd numbers) | Antibodies from human convalescent donors-flow sorted using SARS-CoV-2 receptor binding domain (RBD)-light chain CDR3 sequences |
| 2, 4, 6, through 4760 (even numbers) | Antibodies from human convalescent donors-flow sorted using SARS-CoV-2 receptor binding domain (RBD)-heavy chain CDR3 sequences |
| 4761, 4763, 4765, through 5081 (odd numbers) | Antibodies from human convalescent donors-flow sorted using SARS-CoV-2 spike S1-light chain CDR3 sequences |
| 4762, 4764, 4766, through 5082 (even numbers) | Antibodies from human convalescent donors-flow sorted using SARS-CoV-2 spike S1-heavy chain CDR3 sequences |
| 5083, 5085, 5087, through 6629 (odd numbers) | Antibodies from Trianni mice-flow sorted using SARS-CoV-2 receptor binding domain (RBD)-light chain CDR3 sequences |
| 5084, 5086, 5088, through 6630 (even numbers) | Antibodies from Trianni mice-flow sorted using SARS-CoV-2 receptor binding domain (RBD)-heavy chain CDR3 sequences |
| 6631, 6633, 6635, through 8389 (odd numbers) | Antibodies from Trianni mice-flow sorted using SARS-CoV-2 spike S1-light chain CDR3 sequences |
| 6632, 6634, 6636, through 8390 (even numbers) | Antibodies from Trianni mice-flow sorted using SARS-CoV-2 spike S1-heavy chain CDR3 sequences |

SEQ ID NO: [n], wherein n is an odd number from 4761 to 5081. In some embodiments, the ABP comprises a heavy chain CDR3 having the sequence of SEQ ID NO: [n+1] and a light chain CDR3 has the sequence of SEQ ID NO: [n], wherein n is an odd number from 5083 to 6629. In some embodiments, the ABP comprises a heavy chain CDR3 having the sequence of SEQ ID NO: [n+1] and a light chain CDR3 has the sequence of SEQ ID NO: [n], wherein n is an odd number from 6631 to 8389.

In some embodiments, the ABP comprises a heavy chain CDR1 having the sequence of GFTX$_1$X$_2$X$_3$X$_4$X$_5$ (SEQ ID NO: 8409). In some embodiments, the ABP comprises a heavy chain CDR1 having the sequence of GFT[V/F][S/T][S/F/T][N/S/Y][Y/A/G] (SEQ ID NO: 8391). In some embodiments, the ABP comprises a heavy chain CDR1 having a sequence selected from the group consisting of: GFTVS[S/F]NY (SEQ ID NO: 8392), GFTFTSSA (SEQ ID NO: 8393), GFTFSSYG (SEQ ID NO: 8394), (SEQ ID NO: 8395), and CFTVSTNY (SEQ ID NO: 8396).

In some embodiments, the ABP comprises a heavy chain CDR2 having the sequence of IX$_1$X$_2$X$_3$GX$_4$X$_5$ (SEQ ID NO: 8397). In some embodiments, the ABP comprises a heavy chain CDRs having the sequence of I[Y/W/S][S/G/Y][G/S/D]G[S/N/SN][T/K] (SEQ ID NO: 8398). In some embodiments, the RPP comprises a heavy chaing CDR2 having a sequence selected from the group consisting of: IYSGGST (SEQ ID NO: 8399), IWGSGNT (SEQ ID NO: 8400), ISYDGSNK (SEQ ID NO: 8401), IYSGGST (SEQ ID NO: 8402), and IYSGGST (SEQ ID NO: 8403).

In some embodiments, the ABP comprises a heavy chain CDR3 having the sequence of ARDL[G/S/A][P/A/S][R/A]G[G/Y][I/F]DY (SEQ ID NO: 8404), AAPYCSSTSCHDAFDI (SEQ ID NO: 8405), AKHGYSYGYWLGYFDY (SEQ ID NO: 8406), AR[D/E][C/T/L][L/M][G/V][Y/I][G/P]SMDV (SEQ ID NO: 8407), and ARGHWEYYFDY (SEQ ID NO: 8408)

In some embodiments, the ABP comprises (i) a heavy chain CDR1 having the sequence of GFTVS[S/F]NY (SEQ ID NO: 8392), a heavy chain CDR2 having the sequence of IYSGGST (SEQ ID NO: 8399), and a heavy chain CDR3 having the sequence of ARDL[G/S/A][P/A/S][R/A]G[G/Y][I/F]DY (SEQ ID NO: 8404); (ii) a heavy chain CDR1 having the sequence of GFTFTSSA (SEQ ID NO: 8393), a heavy chain CDR2 having the sequence of IWGSGNT (SEQ ID NO: 8400), and a heavy chain CDR3 having the sequence of AAPYCSSTSCHDAFDI (SEQ ID NO: 8405); (iii) a heavy chain CDR1 having the sequence of GFTFSSYG (SEQ ID NO: 8394), a heavy chain CDR2 having the sequence of ISYDGSNK (SEQ ID NO: 8401), and a heavy chain CDR3 having the sequence of AKHGYSYGYWLGYFDY (SEQ ID NO: 8406); (iv) a heavy chain CDR1 having the sequence of GFTVSSNY (SEQ ID NO: 8395), a heavy chain CDR2 having the sequence of IYSGGST (SEQ ID NO: 8402), and a heavy chain CDR3 having the sequence of AR[D/E][C/T/L][L/M][G/V][Y/I][G/P]SMDV (SEQ ID NO: 8407); or (v) a heavy chain CDR1 having the sequence of CFTVSTNY (SEQ ID NO: 8396), a heavy chain CDR2 having the sequence of IYSGGST (SEQ ID NO: 8403), and a heavy chain CDR3 having the sequence of ARGHWEYYFDY (SEQ ID NO: 8408).

An oligopeptide or polypeptide is within the scope of the invention if it has an amino acid sequence that is at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identical to least one of the CDR sequences provided herein.

In some embodiments, the RPP comprises about 10, 100, 500, 1,000, 5,000, 10,000, 50,000 or more than 100,000 distinct ABPs, each having a unique sequence. In some embodiments, the RPP comprises at least 10, 100, 500, 1,000, 5,000, 10,000, 20,000, 30,000, 40,000, 50,000 or more than 100,000 distinct ABPs, each having a unique sequence.

In some embodiments, the RPP has a binding titer to a SARS-CoV-2 antigen at least 50 times higher than antibodies in a sample obtained from one or more donor exposed to the antigen. The binding titer can be measured by any of the methods known in the art. For example, the binding titer can be measured by anti-SARS-CoV-2-ELISA. In some embodiments, the binding titer of the RPP is at least 100, 200, 300, 400, 500, 600, 700, 800, 900, or 1000 times higher than antibodies in a sample obtained from one or more donor exposed to the SARS-CoV-2 antigen. The sample can be a plasma sample.

In some embodiments, the RPP has a SARS-CoV-2 neutralization titer at least 50 times higher than antibodies in a sample obtained from one or more donor exposed to the antigen. The neutralization titer can be measured by any of the methods known in the art. For example, the neutralization titer can be measured by an in vitro assay. In some embodiments, the neutralization titer of the RPP is at least 100, 200, 300, 400, 500, 600, 700, 800, 900, or 1000 times higher than antibodies in a sample obtained from one or more donor exposed to the SARS-CoV-2 antigen. The sample can be a plasma sample.

In some embodiments, the RPP comprises ABPs selected based on their activity. For example, the RPP comprises ABPs selected based on their binding or neutralization activity against COVID-19. In some embodiments, the ABP contains a mix of RPPs selected for their activity against different types or variants of COVID-19.

Nucleic Acids

In one aspect, the present invention provides isolated nucleic acid molecules. The nucleic acids comprise, for example, polynucleotides that encode all or part of an RPP, for example, one or both chains of an antibody of the invention, or a fragment, derivative, mutein, or variant thereof, polynucleotides sufficient for use as hybridization probes, PCR primers or sequencing primers for identifying, analyzing, mutating or amplifying a polynucleotide encoding a polypeptide, anti-sense nucleic acids for inhibiting expression of a polynucleotide, and complementary sequences of the foregoing. The nucleic acids can be any length. They can be, for example, 5, 10, 15, 20, 25, 30, 35, 40, 45, 50, 75, 100, 125, 150, 175, 200, 250, 300, 350, 400, 450, 500, 750, 1,000, 1,500, 3,000, 5,000 or more nucleotides in length, and/or can comprise one or more additional sequences, for example, regulatory sequences, and/or be part of a larger nucleic acid, for example, a vector. The nucleic acids can be single-stranded or double-stranded and can comprise RNA and/or DNA nucleotides, and artificial variants thereof (e.g., peptide nucleic acids).

Polynucleotides encoding antibody polypeptides (e.g., heavy or light chain, variable domain only, CDRs only, or full length) can be isolated from B cells, plasma cells, or plasmablasts of a subject that has been exposed to an antigen, e.g., by being infected by virus or immunized with a vaccine. The nucleic acid can be isolated by conventional procedures such as polymerase chain reaction (PCR) or methods described herein (e.g., single cell OE-RT-PCR).

Polypeptide sequences of the CDR3 from the variable regions of the heavy and light chain variable regions are shown herein. The skilled artisan will appreciate that, due to the degeneracy of the genetic code, each of the polypeptide sequences disclosed herein is encoded by a large number of other nucleic acid sequences. The present invention provides each degenerate nucleotide sequence encoding each RPP of the invention.

Methods for hybridizing nucleic acids are well-known in the art. See, e.g., Curr. Prot. in Mol. Biol., John Wiley & Sons, N.Y. (1989), 6.3.1-6.3.6. As defined herein, a moderately stringent hybridization condition uses a prewashing solution containing 5× sodium chloride/sodium citrate (SSC), 0.5% SDS, 1.0 mM EDTA (pH 8.0), hybridization buffer of about 50% formamide, 6×SSC, and a hybridization temperature of 55° C. (or other similar hybridization solutions, such as one containing about 50% formamide, with a hybridization temperature of 42° C.), and washing conditions of 60° C., in 0.5×SSC, 0.1% SDS. A stringent hybridization condition hybridizes in 6×SSC at 45° C., followed by one or more washes in 0.1×SSC, 0.2% SDS at 68° C. Furthermore, one of skill in the art can manipulate the hybridization and/or washing conditions to increase or decrease the stringency of hybridization such that nucleic acids comprising nucleotide sequences that are at least 65, 70, 75, 80, 85, 90, 95, 98, or 99% identical to each other typically remain hybridized to each other. The basic parameters affecting the choice of hybridization conditions and guidance for devising suitable conditions are set forth by, for example, Sambrook, Fritsch, and Maniatis (1989, Molecular Cloning: A Laboratory Manual, Cold Spring Harbor Laboratory Press, Cold Spring Harbor, N.Y., chapters 9 and 11; and Curr. Prot. in Mol. Biol. 1995, Ausubel et al., eds., John Wiley & Sons, Inc., sections 2.10 and 6.3-6.4), and can be readily determined by those having ordinary skill in the art based on, for example, the length and/or base composition of the DNA.

Changes can be introduced by mutation into a nucleic acid, thereby leading to changes in the amino acid sequence of a polypeptide (e.g., an RPP) that it encodes. Mutations can be introduced using any technique known in the art. In one embodiment, one or more particular amino acid residues are changed using, for example, a site-directed mutagenesis protocol. In another embodiment, one or more randomly selected residues are changed using, for example, a random mutagenesis protocol. However, it is made, a mutant polypeptide can be expressed and screened for a desired property (e.g., binding to a virus).

In another aspect, the present invention provides nucleic acid molecules that are suitable for use as primers or hybridization probes for the detection of nucleic acid sequences of the invention. A nucleic acid molecule of the invention can comprise only a portion of a nucleic acid sequence encoding a full-length polypeptide of the invention, for example, a fragment that can be used as a probe or primer or a fragment encoding an active portion (e.g., a virus binding portion) of a polypeptide of the invention.

Probes based on the sequence of a nucleic acid of the invention can be used to detect the nucleic acid or similar nucleic acids, for example, transcripts encoding a polypeptide of the invention. The probe can comprise a label group, e.g., a radioisotope, a fluorescent compound, an enzyme, or an enzyme co-factor. Such probes can be used to identify a cell that expresses the polypeptide In another aspect, the present invention provides libraries of nucleic acids that encode for RPP or a variant or derivative thereof, derived from B cells, plasmablasts, and plasma cells. These libraries of nucleic acids are generated by isolating plasmablasts and plasma cells into single-cell reaction containers, wherein they are lysed and antibody-specific nucleic acids are purified or captured, for example on solid supports such as beads. The present invention provides methods for performing capture of transcripts from millions of single cells in parallel. Capture of transcripts is followed by amplification of nucleic acids that encode heavy and light chain immunoglobulins, and subsequent linkage of said nucleic acids into libraries of fused constructs that encode both heavy and light chain immunoglobulins. In such libraries the native pairing of heavy and light chain immunoglobulins, as originally found in the input B cells, plasmablasts, and plasma cells, is maintained. Such methods are performed in parallel on millions of single cells, such that the resulting library of fused heavy and light chain immunoglobulin nucleic acids comprises natively paired sequences for millions of single cells. Such methods are described elsewhere (Adler et al., *Mabs* 9, 1282-1996, 2017; WO2020/223573 which are incorporated by reference in its entirety herein).

Vectors and Host Cells

The present invention provides vectors, each vector comprising a nucleic acid encoding a polypeptide of the invention or a portion thereof. Examples of vectors include, but are not limited to, plasmids, viral vectors, non-episomal mammalian vectors and expression vectors, for example, recombinant expression vectors.

In another aspect of the present invention, expression vectors containing the nucleic acid molecules and polynucleotides of the present invention are also provided, and host cells transformed with such vectors, and methods of producing the polypeptides are also provided. The term "expression vector" refers to a plasmid, phage, virus or vector for expressing a polypeptide from a polynucleotide sequence. Vectors for the expression of the polypeptides contain at a minimum sequence required for vector propagation and for expression of the cloned insert. An expression vector comprises a transcriptional unit comprising an assembly of (1) a genetic element or elements having a regulatory role in gene expression, for example, promoters or enhancers, (2) a sequence that encodes polypeptides and proteins to be transcribed into mRNA and translated into protein, and (3) appropriate transcription initiation and termination sequences. These sequences may further include a selection marker. Vectors suitable for expression in host cells are readily available and the nucleic acid molecules are inserted into the vectors using standard recombinant DNA techniques. Such vectors can include promoters which function in specific cells or tissues, and viral vectors for the expression of polypeptides in targeted human or animal cells.

The recombinant expression vectors of the invention can comprise a nucleic acid of the invention in a form suitable for expression of the nucleic acid in a host cell. The recombinant expression vectors include one or more regulatory sequences, selected on the basis of the host cells to be used for expression, which is operably linked to the nucleic acid sequence to be expressed. Regulatory sequences include those that direct constitutive expression of a nucleotide sequence in many types of host cells (e.g., SV40 early gene enhancer, Rous sarcoma virus promoter and cytomegalovirus promoter), those that direct expression of the nucleotide sequence only in certain host cells (e.g., tissue-specific regulatory sequences, see Voss et al., 1986, Trends Biochem. Sci. 11:287, Maniatis et al., 1987, Science 236:1237, incorporated by reference herein in their entireties), and those that direct inducible expression of a nucleotide sequence in response to particular treatment or condition (e.g., the metallothionin promoter in mammalian cells and the tet-responsive and/or streptomycin responsive promoter in both prokaryotic and eukaryotic systems (see id.). It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein.

The invention further provides methods of making polypeptides, e.g., RPP. A variety of other expression/host systems may be utilized. Vector DNA can be introduced into prokaryotic or eukaryotic systems via conventional transformation or transfection techniques. These systems include but are not limited to microorganisms such as bacteria (for example, E. coli) transformed with recombinant bacteriophage, plasmid or cosmid DNA expression vectors; yeast transformed with yeast expression vectors; insect cell systems infected with virus expression vectors (e.g., baculovirus); plant cell systems transfected with virus expression vectors (e.g., cauliflower mosaic virus, CaMV; tobacco mosaic virus, TMV) or transformed with bacterial expression vectors (e.g., Ti or pBR322 plasmid); or animal cell systems. Mammalian cells useful in recombinant protein production include but are not limited to VERO cells, HeLa cells, Chinese hamster ovary (CHO) cell lines, or their derivatives such as Veggie CHO and related cell lines which grow in serum-free media (see Rasmussen et al., 1998, Cytotechnology 28:31) or CHO strain DX-B11, which is deficient in DHFR (see Urlaub et al., 1980, Proc. Natl. Acad. Sci. USA 77:4216-20) COS cells such as the COS-7 line of monkey kidney cells (ATCC CRL 1651) (see Gluzman et al., 1981, Cell 23:175), W138, BHK, HepG2, 3T3 (ATCC CCL 163), RIN, MDCK, A549, PC12, K562, L cells, C127 cells, BHK (ATCC CRL 10) cell lines, the CV1/EBNA cell line derived from the African green monkey kidney cell line CV1 (ATCC CCL 70) (see McMahan et al., 1991, EMBO J. 10:2821), human embryonic kidney cells such as 293, 293 EBNA or MSR 293, human epidermal A431 cells, human Colo205 cells, other transformed primate cell lines, normal diploid cells, cell strains derived from in vitro culture of primary tissue, primary explants, HL-60, U937, HaK or Jurkat cells. Mammalian expression allows for the production of secreted or soluble polypeptides which may be recovered from the growth medium.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Once such cells are transformed with vectors that contain selectable markers as well as the desired expression cassette, the cells can be allowed to grow in an enriched media before they are switched to selective media, for example. The selectable marker is designed to allow growth and recovery of cells that successfully express the introduced sequences. Resistant clumps of stably transformed cells can be proliferated using tissue culture techniques appropriate to the cell line employed. An overview of expression of recombinant proteins is found in Methods of Enzymology, v. 185, Goeddell, D. V., ed., Academic Press (1990). Preferred selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die), among other methods.

The transformed cells can be cultured under conditions that promote expression of the polypeptide, and the polypeptide can be recovered by conventional protein purification procedures (as defined above).

In some cases, such as in expression using prokaryotic systems, the expressed polypeptides of this invention may need to be "refolded" and oxidized into a proper tertiary structure and disulfide linkages generated in order to be biologically active. Refolding can be accomplished using a number of procedures well known in the art. Such methods include, for example, exposing the solubilized polypeptide to a pH usually above 7 in the presence of a chaotropic agent. The selection of chaotrope is similar to the choices used for inclusion body solubilization; however, a chaotrope is typically used at a lower concentration. Exemplary chaotropic agents are guanidine and urea. In most cases, the refolding/oxidation solution will also contain a reducing agent plus its oxidized form in a specific ratio to generate a particular redox potential which allows for disulfide shuffling to occur for the formation of cysteine bridges. Some commonly used redox couples include cysteine/cystamine, glutathione/dithiobisGSH, cupric chloride, dithiothreitol DTT/dithiane DTT, and 2-mercaptoethanol (bME)/dithio-bME. In many instances, a co-solvent may be used to increase the efficiency of the refolding. Commonly used cosolvents include glycerol, polyethylene glycol of various molecular weights, and arginine.

In addition, the polypeptides can be synthesized in solution or on a solid support in accordance with conventional techniques. Various automatic synthesizers are commercially available and can be used in accordance with known protocols. See, for example, Stewart and Young, Solid Phase Peptide Synthesis, 2d.Ed., Pierce Chemical Co. (1984); Tam et al., J Am Chem Soc, 105:6442, (1983); Merrifield, Science 232:341-347 (1986); Barany and Merrifield, The Peptides, Gross and Meienhofer, eds, Academic Press, New York, 1-284; Barany et al., Int J Pep Protein Res, 30:705-739 (1987).

The polypeptides and proteins of the present invention can be purified according to protein purification techniques well known to those of skill in the art. These techniques involve, at one level, the crude fractionation of the proteinaceous and non-proteinaceous fractions. Having separated the peptide polypeptides from other proteins, the peptide or polypeptide of interest can be further purified using chromatographic and electrophoretic techniques to achieve partial or complete purification (or purification to homogeneity). The term "purified polypeptide" as used herein, is intended to refer to a composition, isolatable from other components, wherein the polypeptide is purified to any degree relative to its naturally-obtainable state. A purified polypeptide therefore also refers to a polypeptide that is free from the environment in which it may naturally occur. Generally, "purified" will refer to a polypeptide composition that has been subjected to fractionation to remove various other components, and which composition substantially retains its expressed biological activity. Where the term "substantially purified" is used, this designation will refer to a peptide or polypeptide composition in which the polypeptide or peptide forms the major component of the composition, such as constituting about 50%, about 60%, about 70%, about 80%, about 85%, or about 90% or more of the proteins in the composition.

Various techniques suitable for use in purification are well known to those of skill in the art. These include, for example, precipitation with ammonium sulphate, PEG, antibodies (immunoprecipitation) and the like or by heat denaturation, followed by centrifugation; chromatography such as affinity chromatography (Protein-A columns), ion exchange, gel filtration, reverse phase, hydroxylapatite, hydrophobic interaction chromatography, isoelectric focusing, gel electrophoresis, and combinations of these techniques. As is generally known in the art, it is believed that the order of conducting the various purification steps may be changed, or that certain steps may be omitted, and still result in a suitable method for the preparation of a substantially purified polypeptide. Exemplary purification steps are provided in the Examples below.

Various methods for quantifying the degree of purification of polypeptide are known to those of skill in the art in light of the present disclosure. These include, for example, determining the specific binding activity of an active fraction, or assessing the amount of peptide or polypeptide within a fraction by SDS/PAGE analysis. A preferred method for assessing the purity of a polypeptide fraction is to calculate the binding activity of the fraction, to compare it to the binding activity of the initial extract, and to thus calculate the degree of purification, herein assessed by a "– fold purification number." The actual units used to represent the amount of binding activity are, of course, be dependent upon the particular assay technique chosen to follow the purification and whether or not the polypeptide or peptide exhibits a detectable binding activity.

In some aspects, the present invention includes libraries of antibody-encoding nucleic acid vectors for site-directed integration into mammalian genomes. Such vectors include plasmids, retroviruses, and lentivirus. These libraries of vectors encode libraries of antibody sequences, which are then be used to engineer mammalian cells for production of RPPs. The libraries of nucleic acid vectors may include 10, 100, 1,000, 10,000, or more than 100,000 different antibody-encoding sequences. The sequences are derived from plasmablasts and plasma cells. These libraries of nucleic acids are generated by isolating plasmablasts and plasma cells into single-cell reaction containers, wherein they are lysed and antibody-specific nucleic acids are purified or captured, for example on solid supports such as beads. The present invention provides methods for performing capture of transcripts from millions of single cells in parallel. Capture of transcripts is followed by amplification of nucleic acids that encode heavy and light chain immunoglobulins, and subsequent linkage of said nucleic acids into libraries of fused constructs that encode both heavy and light chain immunoglobulins. In such libraries the native pairing of heavy and light chain immunoglobulins, as originally found in the input plasmablasts and plasma cells, is maintained. Such methods are performed in parallel on millions of single cells, such that the resulting library of fused heavy and light chain immunoglobulin nucleic acids comprises natively paired sequences for millions of single cells. These paired fused amplicons are then engineered into full-length antibody constructs using Gibson Assembly, restriction endonucleases, or other recombinant DNA techniques. Engineering into full-length antibody constructs is performed on the full library en masse, such that the antibody sequence content and antibody sequence counts of the library are essentially maintained throughout the process. In some aspects, the library of expression vectors is engineered in two steps, such that the scFv amplicon is subcloned into an intermediate vector, and then a second round of Gibson Assembly, restriction digestion, or other recombinant technique is used to engineer additional domains of the antibody into the linker of the scFv. The method is described in U.S. Pat. No. 9,422,547, which is incorporated by reference in its entirety herein. The native pairing of heavy and light chain immunoglobulins is essentially maintained throughout the process of engineering into full-length expression vector libraries. The vectors are designed in various orientations, for example, two separate promoters drive expression of heavy and light chain immunoglobulins, or one promoter drives expression of both heavy and light chain immunoglobulins, and a translational skip motif is used to separately translate the heavy and light chain immunoglobulins into separate polypeptides. In some embodiments, the expression vectors comprise sequences for site-directed integration into mammalian production cells, for example, CRISPR-Cas9, Flp-In, Cre/Lox, or zinc finger recombination methods. Site-directed integration ensures that each mammalian production cell encodes a single antibody sequence, and decreases variability in expression levels between single production cells.

In another aspect, the present disclosure provides a host cell or a library of host cells, each comprising a polynucleotide encoding the RPP described herein. In some embodiments, the host cell comprises a vector or comprises a polynucleotide stably integrated into its genome. In some embodiments, the host cell comprises a polynucleotide encoding a RPP stably integrated into the genome using a Flp recombinase recognition target (FRT) landing pad or a similar method known in the art. In some embodiments, the host cell is a mammalian or prolaryotic cell. In some embodiments, the host cell is a human cell or a yeast cell. In some embodiments, the host cell is CHO cell.

In some embodiments, the host cell comprises an expression vector or integrated polynucleotide for production of RPPs. In some embodiments, a library of host cells can be used produce a RPP described herein. In some embodiments, a library of host cells comprise cells selected based on their production yields or neutralization or binding titers of RPP produced by them.

Methods of Producing RPP

The RPP can be purified from host cells that comprises a gene encoding the RPP by elution of filtered supernatant of host cell culture fluid using a Heparin HP column, using a salt gradient, or with protein A resin.

Fully human monoclonal antibodies may be generated by any number of techniques with which those having ordinary skill in the art will be familiar. Such methods include, but are not limited to, Epstein Barr Virus (EBV) transformation of human peripheral blood cells (e.g., containing B lymphocytes), in vitro immunization of human B-cells, fusion of spleen cells from immunized transgenic mice carrying inserted human immunoglobulin genes, isolation from human immunoglobulin V region phage libraries, or other procedures as known in the art and based on the disclosure herein. For example, fully human monoclonal antibodies may be obtained from transgenic mice that have been engineered to produce specific human antibodies in response to antigenic challenge. Methods for obtaining fully human antibodies from transgenic mice are described, for example, by Green et al., *Nature Genet.* 7:13, 1994; Lonberg et al., *Nature* 368:856, 1994; Taylor et al., *Int. Immun.* 6:579, 1994; U.S. Pat. No. 5,877,397; Bruggemann et al., 1997 *Curr. Opin. Biotechnol.* 8:455-58; Jakobovits et al., 1995 *Ann. N. Y. Acad. Sci.* 764:525-35. In this technique, elements of the human heavy and light chain locus are introduced into strains of mice derived from embryonic stem cell lines that contain targeted disruptions of the endogenous heavy chain and light chain loci (see also Bruggemann et al., *Curr. Opin. Biotechnol.* 8:455-58 (1997)). For example, human immunoglobulin transgenes may be mini-gene constructs, or transloci on yeast artificial chromosomes, which undergo B-cell-specific DNA rearrangement and hypermutation in the mouse lymphoid tissue. Fully human monoclonal antibodies may be obtained by immunizing the transgenic mice, which may then produce human antibodies specific for the antigen target or targets. Lymphoid cells of the immunized transgenic mice can be used to produce human antibody-secreting hybridomas according to the methods described herein.

Another method for generating human antibodies of the invention includes immortalizing human peripheral blood cells by EBV transformation. See, e.g., U.S. Pat. No. 4,464,456. Such an immortalized B-cell line (or lymphoblastoid cell line) producing an RPP that specifically binds to target or targets can be identified by immunodetection methods as provided herein, for example, an ELISA, and then isolated by standard cloning techniques. The stability of the lymphoblastoid cell line producing an RPP may be improved by fusing the transformed cell lines with a murine myeloma to produce a mouse-human hybrid cell line according to methods known in the art (see, e.g., Glasky et al., *Hybridoma* 8:377-89 (1989)). Still another method to generate human RPPs is in vitro immunization, which includes priming human splenic B-cells with antigen targets, followed by fusion of primed with a heterohybrid fusion partner. See, e.g., Boerner et al., 1991 *J. Immunol.* 147:86-95.

In certain embodiments, B-cells that are producing a RPP are selected and the light chain and heavy chain variable regions are cloned from the B-cell according to molecular biology techniques known in the art (WO 92/02551; U.S. Pat. No. 5,627,052; Babcook et al., *Proc. Natl. Acad. Sci. USA* 93:7843-48 (1996)) and described herein. B-cells from an immunized animal may be isolated from the spleen, lymph node, or peripheral blood sample by selecting a cell that is producing an antibody that specifically binds to to the antigen target. B-cells may also be isolated from humans, for example, from a peripheral blood sample.

Methods for detecting single B-cells that are producing an antibody with the desired specificity are well known in the art, for example, by plaque formation, fluorescence-activated cell sorting, in vitro stimulation followed by detection of specific antibody, and the like. Methods for selection of specific antibody-producing B-cells include, for example, preparing a single cell suspension of B-cells in soft agar that contains the antigen target. Binding of the specific antibodies produced by the B-cell to the antigen results in the formation of a complex, which may be visible as an immunoprecipitate.

In some embodiments, specific antibody-producing B-cells are selected by using a method that allows identification natively paired antibodies. For example, a method described in Adler et al., A natively paired antibody library yields drug leads with higher sensitivity and specificity than a randomly paired antibody library, MAbs (2018), which is incorporated by reference in its entirety herein, can be employed. The method combines microfluidic technology, molecular genomics, yeast single-chain variable fragment (scFv) display, fluorescence-activated cell sorting (FACS) and deep sequencing. In short, B cells can be isolated from immunized animals and then pooled. The B cells are encapsulated into droplets with oligo-dT beads and a lysis solution, and mRNA-bound beads are purified from the droplets, and then injected into a second emulsion with an OE-RT-PCR amplification mix that generates DNA amplicons that encode scFv with native pairing of heavy and light chain Ig. Libraries of natively paired amplicons are then electroporated into yeast for scFv display. FACS is used to identify high affinity scFv. Finally, deep antibody sequencing can be used to identify all clones in the pre- and post-sort scFv libraries.

After the B-cells producing the desired antibody are selected, the specific antibody genes may be cloned by isolating and amplifying DNA or mRNA according to methods known in the art and described herein.

The methods for obtaining antibodies of the invention can also adopt various phage display technologies known in the art. See, e.g., Winter et al., 1994 *Annu. Rev. Immunol.* 12:433-55; Burton et al., 1994 *Adv. Immunol.* 57:191-280. Human or murine immunoglobulin variable region gene combinatorial libraries may be created in phage vectors that can be screened to select Ig fragments (Fab, Fv, sFv, or multimers thereof) that bind specifically to the RPP or variant or fragment thereof. See, e.g., U.S. Pat. No. 5,223,409; Huse et al., 1989 *Science* 246:1275-81; Sastry et al., *Proc. Natl. Acad. Sci. USA* 86:5728-32 (1989); Alting-Mees et al., *Strategies in Molecular Biology* 3:1-9 (1990); Kang et al., 1991 *Proc. Natl. Acad. Sci. USA* 88:4363-66; Hoogenboom et al., 1992 *J. Molec. Biol.* 227:381-388; Schlebusch et al., 1997 *Hybridoma* 16:47-52 and references cited therein. For example, a library containing a plurality of polynucleotide sequences encoding Ig variable region fragments may be inserted into the genome of a filamentous bacteriophage, such as M13 or a variant thereof, in frame with the sequence encoding a phage coat protein. A fusion protein may be a fusion of the coat protein with the light chain variable region domain and/or with the heavy chain variable region domain. According to certain embodiments, immunoglobulin Fab fragments may also be displayed on a phage particle (see, e.g., U.S. Pat. No. 5,698,426).

In one embodiment, in a hybridoma the variable regions of a gene expressing a monoclonal antibody of interest are amplified using nucleotide primers. These primers may be synthesized by one of ordinary skill in the art, or may be purchased from commercially available sources. (See, e.g., Stratagene (La Jolla, Calif.), which sells primers for mouse and human variable regions including, among others, primers for $V_{Ha}$, $V_{Hb}$, $V_{Hc}$, $V_{Hd}$, $C_{H1}$, $V_L$ and $C_L$ regions.) These primers may be used to amplify heavy or light chain variable regions, which may then be inserted into vectors such as ImmunoZAP™H or ImmunoZAP™L (Stratagene), respectively. These vectors may then be introduced into *E. coli*, yeast, or mammalian-based systems for expression. Large amounts of a single-chain protein containing a fusion of the $V_H$ and $V_L$ domains may be produced using these methods (see Bird et al., *Science* 242:423-426, 1988).

Once cells producing antibodies according to the invention have been obtained using any of the above-described immunization and other techniques, the specific antibody genes may be cloned by isolating and amplifying DNA or mRNA therefrom according to standard procedures as described herein. The antibodies produced therefrom may be sequenced and the CDRs identified and the DNA coding for the CDRs may be manipulated as described previously to generate other antibodies according to the invention.

RPP of the present invention preferably have activity in the cell-based assays described herein and/or in the in vivo assay described herein and/or bind to one or more of the antigens described herein. Accordingly, such binding agents can be identified using the assays described herein.

Other antibodies according to the invention may be obtained by conventional immunization and cell fusion procedures as described herein and known in the art.

Molecular evolution of the complementarity determining regions (CDRs) in the center of the antibody binding site also has been used to isolate antibodies with increased affinity, for example, antibodies having increased affinity for c-erbB-2, as described by Schier et al., 1996, *J. Mol. Biol.* 263:551.

Human, partially human, or humanized antibodies are suitable for many applications, particularly those involving administration of the antibody to a human subject, other types of antigen binding proteins. The non-human antibodies of the invention can be, for example, derived from any antibody-producing animal, such as mouse, rat, rabbit, goat, donkey, or non-human primate (such as monkey (e.g., cynomologous or rhesus monkey) or ape (e.g., chimpanzee)). Non-human antibodies of the invention can be used, for example, in in vitro and cell-culture based applications, or any other application where an immune response to the antibody of the invention does not occur, is insignificant, can be prevented, is not a concern, or is desired. In one embodiment, a non-human antibody of the invention is administered to a non-human subject. In another embodiment, the non-human antibody does not elicit an immune response in the non-human subject. In another embodiment, the non-human antibody is from the same species as the non-human subject, e.g., a mouse antibody of the invention is administered to a mouse. An antibody from a particular species can be made by, for example, immunizing an animal of that species with the desired immunogen or using an artificial system for generating antibodies of that species (e.g., a bacterial or phage display-based system for generating antibodies of a particular species), or by converting an antibody from one species into an antibody from another species by replacing, e.g., the constant region of the antibody with a constant region from the other species, or by replacing one or more amino acid residues of the antibody so that it more closely resembles the sequence of an antibody from the other species. In one embodiment, the antibody is a chimeric antibody comprising amino acid sequences derived from antibodies from two or more different species.

ABPs may be prepared, and screened for desired properties, by any of a number of conventional techniques. Certain of the techniques involve isolating a nucleic acid encoding a polypeptide chain (or portion thereof) of an RPP of interest, and manipulating the nucleic acid through recombinant DNA technology. The nucleic acid may be fused to another nucleic acid of interest, or altered (e.g., by mutagenesis or other conventional techniques) to add, delete, or substitute one or more amino acid residues, for example. Furthermore, the antigen binding proteins may be purified from cells that naturally express them (e.g., an antibody can be purified from a hybridoma that produces it), or produced in recombinant expression systems, using any technique known in the art. See, for example, *Monoclonal Antibodies, Hybridomas: A New Dimension in Biological Analyses*, Kennet et al. (eds.), Plenum Press, New York (1980); and *Antibodies: A Laboratory Manual*, Harlow and Land (eds.), Cold Spring Harbor Laboratory Press, Cold Spring Harbor, N.Y., (1988).

Any expression system known in the art can be used to make the recombinant polypeptides of the invention. Expression systems are detailed comprehensively above. In general, host cells are transformed with a recombinant expression vector that comprises DNA encoding a desired polypeptide. Among the host cells that may be employed are prokaryotes, yeast or higher eukaryotic cells. Prokaryotes include gram negative or gram-positive organisms, for example *E. coli* or *Bacilli*. Higher eukaryotic cells include insect cells and established cell lines of mammalian origin. Examples of suitable mammalian host cell lines include the COS-7 line of monkey kidney cells (ATCC CRL 1651) (Gluzman et al., 1981, Cell 23:175), L cells, 293 cells, C127 cells, 3T3 cells (ATCC CCL 163), Chinese hamster ovary (CHO) cells, HeLa cells, BHK (ATCC CRL 10) cell lines, and the CVI/EBNA cell line derived from the African green monkey kidney cell line CVI (ATCC CCL 70) as described by McMahan et al., 1991, EMBO J. 10: 2821. Appropriate cloning and expression vectors for use with bacterial, fungal, yeast, and mammalian cellular hosts are described by Pouwels et al. (*Cloning Vectors: A Laboratory Manual*, Elsevier, N.Y., 1985).

Production cell lines for monoclonal antibodies (mAbs) are typically produced by randomly inserting expression constructs into a mammalian production cell genome, for example, a CHO genome (Rita Costa et al., 2010). However, this canonical method produces cell lines with multiple copies of mAb inserted into the CHO genome. If the polyclonal antibody construct libraries were randomly inserted into the CHO genome, many clones would express multiple antibodies, which would result in frequent non-native pairing between heavy and light chain Ig. Additionally, different genome locations have different transcriptional activity levels (Kito et al., 2002), which could result in heterogeneous, inconsistent and/or unstable bioproduction. Thus, in some aspects the current invention provides a CHO cell line with a Flp recombinase recognition target (FRT) landing pad stably engineered into the genome. Such site-directed genome integration cell lines are then used for stable expression of RPP.

It will be appreciated that an antibody of the present invention may have at least one amino acid substitution, providing that the antibody retains binding specificity. Therefore, modifications to the antibody structures are encompassed within the scope of the invention. These may include amino acid substitutions, which may be conservative or non-conservative that do not destroy the binding capability of an antibody comprising the RPP. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid moieties. A conservative amino acid substitution may also involve a substitution of a native amino acid residue with a normative residue such that there is little or no effect on the polarity or charge of the amino acid residue at that position.

Non-conservative substitutions may involve the exchange of a member of one class of amino acids or amino acid mimetics for a member from another class with different physical properties (e.g. size, polarity, hydrophobicity, charge). Such substituted residues may be introduced into regions of the human antibody that are homologous with non-human antibodies, or into the non-homologous regions of the molecule.

Moreover, one skilled in the art may generate test variants containing a single amino acid substitution at each desired amino acid residue. The variants can then be screened using activity assays known to those skilled in the art. Such variants could be used to gather information about suitable variants. For example, if one discovered that a change to a particular amino acid residue resulted in destroyed, undesirably reduced, or unsuitable activity, variants with such a change may be avoided. In other words, based on information gathered from such routine experiments, one skilled in the art can readily determine the amino acids where further substitutions should be avoided either alone or in combination with other mutations.

A skilled artisan will be able to determine suitable variants of the polypeptide as set forth herein using well-known techniques. In certain embodiments, one skilled in the art may identify suitable areas of the molecule that may be changed without destroying activity by targeting regions not believed to be important for activity. In certain embodiments, one can identify residues and portions of the molecules that are conserved among similar polypeptides. In certain embodiments, even areas that may be important for biological activity or for structure may be subject to conservative amino acid substitutions without destroying the biological activity or without adversely affecting the polypeptide structure.

Additionally, one skilled in the art can review structure-function studies identifying residues in similar polypeptides that are important for activity or structure. In view of such a comparison, one can predict the importance of amino acid residues in a protein that correspond to amino acid residues which are important for activity or structure in similar proteins. One skilled in the art may opt for chemically similar amino acid substitutions for such predicted important amino acid residues.

One skilled in the art can also analyze the three-dimensional structure and amino acid sequence in relation to that structure in similar polypeptides. In view of such information, one skilled in the art may predict the alignment of amino acid residues of an antibody with respect to its three-dimensional structure. In certain embodiments, one skilled in the art may choose not to make radical changes to amino acid residues predicted to be on the surface of the protein, since such residues may be involved in important interactions with other molecules.

A number of scientific publications have been devoted to the prediction of secondary structure. See Moult *J., Curr. Op. in Biotech.,* 7(4):422-427 (1996), Chou et al., *Biochem.,* 13(2):222-245 (1974); Chou et al., *Biochem.,* 113(2):211-222 (1974); Chou et al., *Adv. Enzymol. Relat. Areas Mol. Biol.,* 47:45-148 (1978); Chou et al., *Ann. Rev. Biochem.,* 47:251-276 and Chou et al., *Biophys. J.,* 26:367-384 (1979). Moreover, computer programs are currently available to assist with predicting secondary structure. One method of predicting secondary structure is based upon homology modeling. For example, two polypeptides or proteins which have a sequence identity of greater than 30%, or similarity greater than 40% often have similar structural topologies. The recent growth of the protein structural database (PDB) has provided enhanced predictability of secondary structure, including the potential number of folds within a polypeptide's or protein's structure. See Holm et al., *Nucl. Acid. Res.,* 27(1):244-247 (1999). It has been suggested (Brenner et al., *Curr. Op. Struct. Biol.,* 7(3):369-376 (1997)) that there are a limited number of folds in a given polypeptide or protein and that once a critical number of structures have been resolved, structural prediction will become dramatically more accurate.

Additional methods of predicting secondary structure include "threading" (Jones, D., *Curr. Opin. Struct. Biol.,* 7(3):377-87 (1997); Sippl et al., *Structure,* 4(1):15-19 (1996)), "profile analysis" (Bowie et al., *Science,* 253:164-170 (1991); Gribskov et al., *Meth. Enzym.,* 183:146-159 (1990); Gribskov et al., *Proc. Nat. Acad. Sci.,* 84(13):4355-4358 (1987)), and "evolutionary linkage" (See Holm, supra (1999), and Brenner, supra (1997)).

In certain embodiments, variants of antibodies include glycosylation variants wherein the number and/or type of glycosylation site has been altered compared to the amino acid sequences of a parent polypeptide. In certain embodiments, variants comprise a greater or a lesser number of N-linked glycosylation sites than the native protein. An N-linked glycosylation site is characterized by the sequence: Asn-X-Ser or Asn-X-Thr, wherein the amino acid residue designated as X can be any amino acid residue except proline. The substitution of amino acid residues to create this sequence provides a potential new site for the addition of an N-linked carbohydrate chain. Alternatively, substitutions which eliminate this sequence will remove an existing N-linked carbohydrate chain. Also provided is a rearrangement of N-linked carbohydrate chains wherein one or more N-linked glycosylation sites (typically those that are naturally occurring) are eliminated and one or more new N-linked sites are created. Additional preferred antibody variants include cysteine variants wherein one or more cysteine residues are deleted from or substituted for another amino acid (e.g., serine) as compared to the parent amino acid sequence. Cysteine variants can be useful when antibodies must be refolded into a biologically active conformation such as after the isolation of insoluble inclusion bodies. Cysteine variants generally have fewer cysteine residues than the native protein, and typically have an even number to minimize interactions resulting from unpaired cysteines.

According to certain embodiments, preferred amino acid substitutions are those which: (1) reduce susceptibility to proteolysis, (2) reduce susceptibility to oxidation, (3) alter binding affinity for forming protein complexes, (4) alter binding affinities, and/or (4) confer or modify other physiochemical or functional properties on such polypeptides. According to certain embodiments, single or multiple amino acid substitutions (in certain embodiments, conservative amino acid substitutions) may be made in the naturally-occurring sequence (in certain embodiments, in the portion of the polypeptide outside the domain(s) forming intermolecular contacts). In certain embodiments, a conservative amino acid substitution typically may not substantially change the structural characteristics of the parent sequence (e.g., a replacement amino acid should not tend to break a helix that occurs in the parent sequence, or disrupt other types of secondary structure that characterizes the parent sequence). Examples of art-recognized polypeptide secondary and tertiary structures are described in Proteins, Structures and Molecular Principles (Creighton, Ed., W. H. Freeman and Company, New York (1984)); Introduction to Protein Structure (C. Branden and J. Tooze, eds., Garland Publishing, New York, N.Y. (1991)); and Thornton et al. *Nature* 354:105 (1991), which are each incorporated herein by reference.

In certain embodiments, ABPs of the invention may be chemically bonded with polymers, lipids, or other moieties.

The binding agents may comprise at least one of the CDRs described herein incorporated into a biocompatible framework structure. In one example, the biocompatible framework structure comprises a polypeptide or portion thereof that is sufficient to form a conformationally stable structural support, or framework, or scaffold, which is able to display one or more sequences of amino acids that bind to an antigen (e.g., CDRs, a variable region, etc.) in a localized surface region. Such structures can be a naturally occurring polypeptide or polypeptide "fold" (a structural motif), or can have one or more modifications, such as additions, deletions or substitutions of amino acids, relative to a naturally occurring polypeptide or fold. These scaffolds can be derived from a polypeptide of any species (or of more than one species), such as a human, other mammal, other vertebrate, invertebrate, plant, bacteria or virus.

Typically, the biocompatible framework structures are based on protein scaffolds or skeletons other than immunoglobulin domains. For example, those based on fibronectin, ankyrin, lipocalin, neocarzinostain, cytochrome b, CP1 zinc finger, PST1, coiled coil, LACI-D1, Z domain and tendamistat domains may be used (See e.g., Nygren and Uhlen, 1997, *Curr. Opin. in Struct. Biol.*, 7, 463-469).

It will be appreciated that the ABPs of the invention include the humanized antibodies described herein. Humanized antibodies such as those described herein can be produced using techniques known to those skilled in the art (Zhang, W., et al., *Molecular Immunology*. 42(12):1445-1451, 2005; Hwang W. et al., *Methods*. 36(1):35-42, 2005; Dall'Acqua W F, et al., *Methods* 36(1):43-60, 2005; and Clark, M., *Immunology Today*. 21(8):397-402, 2000).

Where an antibody comprises one or more of CDR3-H, and/or CDR3-L as described in Table 5, it may be obtained by expression from a host cell containing DNA coding for these sequences. A DNA coding for each CDR sequence may be determined on the basis of the amino acid sequence of the CDR and synthesized together with any desired antibody variable region framework and constant region DNA sequences using oligonucleotide synthesis techniques, site-directed mutagenesis and polymerase chain reaction (PCR) techniques as appropriate. DNA coding for variable region frameworks and constant regions is widely available to those skilled in the art from genetic sequences databases such as GenBank®.

Once synthesized, the DNA encoding an antibody of the invention or fragment thereof may be propagated and expressed according to any of a variety of well-known procedures for nucleic acid excision, ligation, transformation, and transfection using any number of known expression vectors. Thus, in certain embodiments expression of an antibody fragment may be preferred in a prokaryotic host, such as *Escherichia coli* (see, e.g., Pluckthun et al., 1989 *Methods Enzymol.* 178:497-515). In certain other embodiments, expression of the antibody or a fragment thereof may be preferred in a eukaryotic host cell, including yeast (e.g., *Saccharomyces cerevisiae*, *Schizosaccharomyces pombe*, and *Pichia pastoris*), animal cells (including mammalian cells) or plant cells. Examples of suitable animal cells include, but are not limited to, myeloma (such as a mouse NSO line), COS, CHO, or hybridoma cells. Examples of plant cells include tobacco, corn, soybean, and rice cells.

Replicable expression vectors containing DNA encoding an antibody variable and/or constant region may be prepared and used to transform an appropriate cell line, for example, a non-producing myeloma cell line, such as a mouse NSO line or a bacteria, such as *E. coli*, in which production of the antibody will occur. In order to obtain efficient transcription and translation, the DNA sequence in each vector should include appropriate regulatory sequences, particularly a promoter and leader sequence operatively linked to the variable domain sequence. Particular methods for producing antibodies in this way are generally well-known and routinely used. For example, basic molecular biology procedures are described by Maniatis et al. (*Molecular Cloning, A Laboratory Manual*, 2nd ed., Cold Spring Harbor Laboratory, New York, 1989; see also Maniatis et al, 3rd ed., Cold Spring Harbor Laboratory, New York, (2001)). DNA sequencing can be performed as described in Sanger et al. (PNAS 74:5463, (1977)) and the Amersham International plc sequencing handbook, and site directed mutagenesis can be carried out according to methods known in the art (Kramer et al., *Nucleic Acids Res.* 12:9441, (1984); Kunkel *Proc. Natl. Acad. Sci. USA* 82:488-92 (1985); Kunkel et al., *Methods in Enzymol.* 154:367-82 (1987); the Anglian Biotechnology Ltd. handbook). Additionally, numerous publications describe techniques suitable for the preparation of antibodies by manipulation of DNA, creation of expression vectors, and transformation and culture of appropriate cells (Mountain A and Adair, J R in *Biotechnology and Genetic Engineering Reviews* (ed. Tombs, M P, 10, Chapter 1, 1992, Intercept, Andover, UK); "Current Protocols in Molecular Biology", 1999, F. M. Ausubel (ed.), Wiley Interscience, New York).

Where it is desired to improve the affinity of ABPs according to the invention containing one or more of the above-mentioned CDRs can be obtained by a number of affinity maturation protocols including maintaining the CDRs (Yang et al., *J. Mol. Biol.*, 254, 392-403, 1995), chain shuffling (Marks et al., *Bio/Technology*, 10, 779-783, 1992), use of mutation strains of *E. coli*. (Low et al., *J. Mol. Biol.*, 250, 350-368, 1996), DNA shuffling (Patten et al., *Curr. Opin. Biotechnol.*, 8, 724-733, 1997), phage display (Thompson et al., *J. Mol. Biol.*, 256, 7-88, 1996) and sexual PCR (Crameri, et al., *Nature*, 391, 288-291, 1998). All of these methods of affinity maturation are discussed by Vaughan et al. (*Nature Biotech.*, 16, 535-539, 1998).

It will be understood by one skilled in the art that some proteins, such as antibodies, may undergo a variety of posttranslational modifications. The type and extent of these modifications often depends on the host cell line used to express the protein as well as the culture conditions. Such modifications may include variations in glycosylation, methionine oxidation, diketopiperizine formation, aspartate isomerization and asparagine deamidation. A frequent modification is the loss of a carboxy-terminal basic residue (such as lysine or arginine) due to the action of carboxypeptidases (as described in Harris, R. J. *Journal of Chromatography* 705:129-134, 1995).

Pharmaceutical Compositions

Pharmaceutical compositions containing one or more of the RPPs of the present disclosure are also provided. Such compositions comprise a therapeutically or prophylactically effective amount of the polypeptide or protein in a mixture with pharmaceutically acceptable materials.

In some embodiments, the pharmaceutical composition comprises an RPP produced using sequences derived from immune cells of a donor expoosued to one or more SARS-CoV-2 antigens. In some embodiments, the pharmaceutical composition comprises RPPs produced using sequences derived from immune cells of multiple donors expoosued to one or more SARS-CoV-2 antigens. The donors can be a human, non-human animal (mouse, humanized mouse, rat, humanized rat, horse, or cow) or both.

In some embodiments, the pharmaceutical composition comprises a first RPP comprising a first ABPs, wherein each of the first ABPs specifically binds to a first antigen, and a second RPP comprising a second ABPs, wherein each of the second ABPs specifically binds to a second antigen. In some embodiments, the first antigen is SARS-CoV-2 receptor binding domain (RBD) and the second antigen is SARS-CoV-2 spike S1. In some embodiments, the first antigen is SARS-CoV-2 receptor binding domain (RBD) or SARS-CoV-2 spike S1, and the second antigen is a different antigen of SARS-CoV-2.

In some embodiments, the pharmaceutical composition comprises about 10, 100, 500, 1,000, 5,000, 10,000, 50,000 or more than 100,000 distinct ABPs, each having a unique sequence. In some embodiments, the pharmaceutical composition comprises at least 10, 100, 500, 1,000, 5,000, 10,000, 20,000, 30,000, 40,000, 50,000 or more than 100,000 distinct ABPs, each having a unique sequence.

The pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition.

Suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates, other organic acids); bulking agents (such as mannitol or glycine), chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides and other carbohydrates (such as glucose, mannose, or dextrins); proteins (such as serum albumin, gelatin or immunoglobulins); coloring; flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate 80, triton, tromethamine, lecithin, cholesterol, tyloxapal); stability enhancing agents (sucrose or sorbitol); tonicity enhancing agents (such as alkali metal halides (preferably sodium or potassium chloride, mannitol sorbitol); delivery vehicles; diluents; excipients and/or pharmaceutical adjuvants. Neutral buffered saline or saline mixed with conspecific serum albumin are examples of appropriate diluents. In accordance with appropriate industry standards, preservatives such as benzyl alcohol may also be added. The composition may be formulated as a lyophilizate using appropriate excipient solutions (e.g., sucrose) as diluents. Suitable components are nontoxic to recipients at the dosages and concentrations employed. Further examples of components that may be employed in pharmaceutical formulations are presented in Remington's Pharmaceutical Sciences, 16$^{th}$ Ed. (1980) and 20$^{th}$ Ed. (2000), Mack Publishing Company, Easton, Pa.

Optionally, the composition additionally comprises one or more physiologically active agents, for example, an antiviral agent, plasma IVIg, etc. In various embodiments, the composition comprises one, two, three, four, five, or six physiologically active agents in addition to an RPP.

In another embodiment of the invention, the compositions disclosed herein may be formulated in a neutral or salt form. Illustrative pharmaceutically-acceptable salts include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. Upon formulation, solutions will be administered in a manner compatible with the dosage formulation and in such amount as is therapeutically effective.

The carriers can further comprise any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Except insofar as any conventional media or agent is incompatible with the active ingredient, its use in the therapeutic compositions is contemplated. Supplementary active ingredients can also be incorporated into the compositions. The phrase "pharmaceutically-acceptable" refers to molecular entities and compositions that do not produce an allergic or similar untoward reaction when administered to a human.

The optimal pharmaceutical composition will be determined by one skilled in the art depending upon, for example, the intended route of administration, delivery format, and desired dosage. See for example, Remington's Pharmaceutical Sciences, supra. Such compositions may influence the physical state, stability, rate of in vivo release, and rate of in vivo clearance of the polypeptide. For example, suitable compositions may be water for injection, physiological saline solution for parenteral administration.

Content of Pharmaceutically Active Ingredient

In typical embodiments, the active ingredient (i.e., the proteins and polypeptides of the present invention) is present in the pharmaceutical composition at a concentration of at least 0.01 mg/ml, at least 0.1 mg/ml, at least 0.5 mg/ml, or at least 1mg/ml. In certain embodiments, the active ingredient is present in the pharmaceutical composition at a concentration of at least 1 mg/ml, 2 mg/ml, 3 mg/ml, 4 mg/ml, 5 mg/ml, 10 mg/ml, 15 mg/ml, 20 mg/ml, or 25 mg/ml. In certain embodiments, the active ingredient is present in the pharmaceutical composition at a concentration of at least 30 mg/ml, 35 mg/ml, 40 mg/ml, 45 mg/ml or 50 mg/ml. In certain embodiments, the active ingredient is present in the pharmaceutical composition at a concentration of at least 100 mg/ml, 250 mg/ml, 500 mg/ml, 750 mg/ml, 1 g/ml, 5 g/ml, 10 g/ml, or 50 g/ml.

Formulation Generally

The pharmaceutical composition can be in any form appropriate for human or veterinary medicine, including a liquid, an oil, an emulsion, a gel, a colloid, an aerosol or a solid.

The pharmaceutical composition can be formulated for administration by any route of administration appropriate for human or veterinary medicine, including enteral and parenteral routes of administration.

In some embodiments, the pharmaceutical composition is formulated for intravenous, intraperitoneal, intramuscular, or subcutaneous administration. In some embodiments, the pharmaceutical composition is formulated for intravenous injection or intravenous infusion.

In some embodiments, the pharmaceutical composition is formulated for intrathecal or intracerebroventricular administration.

In some embodiments, the pharmaceutical composition is formulated for topical administration.

Pharmacological Compositions Adapted for Injection

For intravenous, cutaneous or subcutaneous injection, or injection at the site of affliction, the active ingredient will be in the form of a parenterally acceptable aqueous solution which is pyrogen-free and has suitable pH, isotonicity and stability. Those of relevant skill in the art are well able to prepare suitable solutions using, for example, isotonic vehicles such as Sodium Chloride Injection, Ringer's Injection, Lactated Ringer's Injection. Preservatives, stabilisers, buffers, antioxidants and/or other additives can be included, as required.

In various embodiments, the unit dosage form is a vial, ampule, bottle, or pre-filled syringe. In some embodiments, the unit dosage form contains 0.01 mg, 0.1 mg, 0.5 mg, 1 mg, 2.5 mg, 5 mg, 10 mg, 12.5 mg, 25 mg, 50 mg, 75 mg, or 100 mg of the pharmaceutical composition. In some embodiments, the unit dosage form contains 125 mg, 150 mg, 175 mg, or 200 mg of the pharmaceutical composition. In some embodiments, the unit dosage form contains at least 250 mg, 1 g, 10 g, 20 g, 30 g, 40 g, 50 g, 60 g, 70 g, 80 g, 90 g, or 100 g of the pharmaceutical composition. In some embodiments, the unit dosage form contains about 250 mg, 1 g, 10 g, 20 g, 30 g, 40 g, 50 g, 60 g, 70 g, 80 g, 90 g, or 100 g of the pharmaceutical composition.

In typical embodiments, the pharmaceutical composition in the unit dosage form is in liquid form. In various embodiments, the unit dosage form contains between 0.1 mL and 50 ml of the pharmaceutical composition. In some embodiments, the unit dosage form contains 1 ml, 2.5 ml, 5 ml, 7.5 ml, 10 ml, 25 ml, or 50 ml of pharmaceutical composition.

In particular embodiments, the unit dosage form is a vial containing 1 ml of the pharmaceutical composition containing an active ingredient (e.g., RPP) at a concentration of 0.01 mg/ml, 0.1 mg/ml, 0.5 mg/ml, or 1mg/ml. In particular embodiments, the unit dosage form is a vial containing 1 ml of the pharmaceutical composition containing an active ingredient (e.g., RPP) at a concentration of 0.01 mg/ml, 0.1 mg/ml, 0.5 mg/ml, 1mg/ml, 2 mg/ml, 3 mg/ml, 4 mg/ml, 5 mg/ml, 10 mg/ml, 15 mg/ml, 20 mg/ml, 25 mg/ml, 30 mg/ml, 35 mg/ml, 40 mg/ml, 45 mg/ml or 50 mg/ml, 100 mg/ml, 250 mg/ml, 500 mg/ml, 750 mg/ml, 1 g/ml, 5 g/ml, 10 g/ml, or 50 g/ml. In some embodiments, the unit dosage form is a vial containing 2 ml of the pharmaceutical composition containing an active ingredient at a concentration of 0.01 mg/ml, 0.1 mg/ml, 0.5 mg/ml, 1mg/ml, 2 mg/ml, 3 mg/ml, 4 mg/ml, 5 mg/ml, 10 mg/ml, 15 mg/ml, 20 mg/ml, 25 mg/ml, 30 mg/ml, 35 mg/ml, 40 mg/ml, 45 mg/ml or 50 mg/ml, 100 mg/ml, 250 mg/ml, 500 mg/ml, 750 mg/ml, 1 g/ml, 5 g/ml, 10 g/ml, or 50 g/ml.

In some embodiments, the pharmaceutical composition is formulated for injection of an active ingredient at a single dose or multiple doses of between 0.010 and 5 g/kg body weight. In some embodiments, the pharmaceutical composition is formulated for injection of an active ingredient at a single dose of 0.010 g/kg body weight. In some embodiments, the pharmaceutical composition is formulated for injection at a single dose of 0.01, 0.05, 0.15, 0.20, 0.25, 0.30, 0.35, 0.40, 0.45, 0.50, 0.55, 0.60, 0.65, 0.70, 0.75, 0.80, 0.85, 0.90, 0.95, or 0.1 g/kg body weight.

In some embodiments, the unit dose contains at least 0.1 g, 0.5 g, 1 g, 1.5 g, 2 g, 2.5 g, 3 g, 3.5 g, 4 g, 5 g, 10 g, 20 g, 30 g, 40 g, or 50 g of the active ingredient (e.g., RPP). In some embodiments, the unit dose contains about 0.1 g, 0.5 g, 1 g, 1.5 g, 2 g, 2.5 g, 3 g, 3.5 g, 4 g, 5 g, 10 g, 20 g, 30 g, 40 g, or 50 g of the active ingredient (e.g., RPP).

The amount of active ingredient which can be combined with a carrier material to produce a single dosage form will generally be that amount of the compound which produces a therapeutic effect.

The pharmaceutical compositions may conveniently be presented in unit dosage form.

The unit dosage form will typically be adapted to one or more specific routes of administration of the pharmaceutical composition.

In some embodiments, the pharmaceutical composition in the unit dosage form is in solid form, such as a lyophilate, suitable for solubilization.

In some embodiments, the unit dosage form is suitable for subcutaneous, intradermal, or intramuscular administration include preloaded syringes, auto-injectors, and autoinject pens, each containing a predetermined amount of the pharmaceutical composition described hereinabove.

In various embodiments, the unit dosage form is a preloaded syringe, comprising a syringe and a predetermined amount of the pharmaceutical composition. In certain preloaded syringe embodiments, the syringe is adapted for subcutaneous administration. In certain embodiments, the syringe is suitable for self-administration. In particular embodiments, the preloaded syringe is a single use syringe.

In certain embodiments, the unit dosage form is an autoinject pen. The autoinject pen comprises an autoinject pen containing a pharmaceutical composition as described herein. In some embodiments, the autoinject pen delivers a predetermined volume of pharmaceutical composition. In other embodiments, the autoinject pen is configured to deliver a volume of pharmaceutical composition set by the user.

7.1.1. Mixtures of Plasma IVIg with Recombinant Hyperimmunes

In some embodiments, a recombinant hyperimmune is spiked into conventional plasma IVIg to increase the anti-pathogen titer of IVIg. In some embodiments, several anti-pathogen recombinant hyperimmunes are spiked into conventional plasma IVIg. Any number of spike-ins can be mixed with plasma IVIg to generate increased titers against any number of pathogens.

In some embodiments, the spike-in recombinant hyperimmunes are mixed with plasma IVIg by the pharmacist. In some embodiments, the spike-in recombinant hyperimmunes are mixed with plasma IVIg by the manufacturer.

Methods of Treating a Disease Responsive to an RPP

In another aspect, methods are presented for treating a subject having a disease responsive to an RPP. The disease can be a viral infection, e.g., COVID-19. In some embodiments, the method comprises administering the pharmaceutical composition, the RPP disclosed herein to a patient infected with coronavirus or having a symptom of COVID-19.

In vivo and/or in vitro assays may optionally be employed to help identify optimal dosage ranges. The precise dose to be employed in the formulation will also depend on the route of administration, and the seriousness of the condition, and should be decided according to the judgment of the practitioner and each subject's circumstances. Effective doses may be extrapolated from dose-response curves derived from in vitro or animal model test systems.

The actual amount administered, and rate and time-course of administration, will depend on the nature and severity of protein aggregation disease being treated. Prescription of treatment, e.g. decisions on dosage etc., is within the responsibility of general practitioners and other medical doctors, and typically takes account of the disorder to be treated, the condition of the individual patient, the site of delivery, the method of administration and other factors known to practitioners. Examples of the techniques and protocols mentioned above can be found in Remington's Pharmaceutical Sciences, 16th edition, Osol, A. (ed), 1980.

In some embodiments, the pharmaceutical composition is administered by injection, infusion, or by topical application. In some embodiments, the pharmaceutical composition is administered by intravenous infusion.

In some embodiments, the pharmaceutical composition is administered at a dose of 0.01, 0.05, 0.15, 0.20, 0.25, 0.30, 0.35, 0.40, 0.45, 0.50, 0.55, 0.60, 0.65, 0.70, 0.75, 0.80, 0.85, 0.90, 0.95, or 0.1 g active ingredient (RPP)/kg body weight. In some embodiments, the pharmaceutical composition is administered at a dose of about 0.01, 0.05, 0.15, 0.20, 0.25, 0.30, 0.35, 0.40, 0.45, 0.50, 0.55, 0.60, 0.65, 0.70, 0.75, 0.80, 0.85, 0.90, 0.95, or 0.1 g active ingredient (RPP)/kg body weight. In some embodiments, the pharmaceutical composition is administered at a dose of more than 0.01, 0.05, 0.15, 0.20, 0.25, 0.30, 0.35, 0.40, 0.45, 0.50, 0.55, 0.60, 0.65, 0.70, 0.75, 0.80, 0.85, 0.90, 0.95, or 0.1 g active ingredient (RPP)/kg body weight.

In some embodiments, the pharmaceutical composition is administered once a day, 2-4 times a day, 2-4 times a week, once a week, or once every two weeks.

In some embodiments, the pharmaceutical composition is administered once, twice, three times, four times, five times, or more. In some embodiments, the pharmaceutical composition is administered once a day for one, two, three, four, five, or more days. In some embodiments, the pharmaceutical composition is administered until the desired outcome is observed.

In some embodiments, the pharmaceutical composition is administered with plasma IVIg.

8. EXAMPLES

Below are examples of specific embodiments for carrying out the present invention. The examples are offered for illustrative purposes only, and are not intended to limit the scope of the present invention in any way. Efforts have been made to ensure accuracy with respect to numbers used (e.g., amounts, temperatures, etc.), but some experimental error and deviation should, of course, be allowed for.

The practice of the present invention will employ, unless otherwise indicated, conventional methods of protein chemistry, biochemistry, recombinant DNA techniques and pharmacology, within the skill of the art. Such techniques are explained fully in the literature. See, e.g., T. E. Creighton, *Proteins: Structures and Molecular Properties* (W. H. Freeman and Company, 1993); A. L. Lehninger, *Biochemistry* (Worth Publishers, Inc., current addition); Sambrook, et al., *Molecular Cloning: A Laboratory Manual* (2nd Edition, 1989); *Methods In Enzymology* (S. Colowick and N. Kaplan eds., Academic Press, Inc.); *Remington's Pharmaceutical Sciences*, 18th Edition (Easton, Pa.: Mack Publishing Company, 1990); Carey and Sundberg *Advanced Organic Chemistry 3rd Ed.* (Plenum Press) Vols A and B(1992).

Example 1: Generation of rCIG Using Immunized Mice

Two RPPs targeting COVID-19 were produced, one selected for binding to the SARS-CoV-2 receptor binding domain (RBD) and the other for binding to the SARS-CoV-2 spike S1 protein, using Trianni immunized mice as the donors. The heavy and light chain CDR3 sequences are provided in Table 5 above.

First, transgenic mice carrying inserted human immunoglobulin genes were immunized with a protocol comprising adjuvant, RBD, and inactivated SARS-CoV-2 virus. Footpad injections were performed on two Trianni Mice twice weekly for four weeks. Before the final boosts, the serum titer of thymocyte antibodies was assessed by flow cytometry, using a dilution series of RBD and Spike S1 antigen. A strong serum response was observed in the animals, with one animal showing a slightly stronger response. Lymph nodes (popliteal, inguinal, axillary, and mesenteric) were surgically removed after sacrifice. Single cell suspensions for each animal were made by manual disruption followed by passage through a 70 μm filter. Next, the EasySep™ Mouse Pan-B Cell Isolation Kit (Stemcell Technologies) negative selection kit was used to isolate B cells from each sample. The lymph node B cell populations were quantified by counting on a C-Chip hemocytometer (Incyto) and assessed for viability using Trypan blue. The cells were then diluted to 5,000-6,000 cells/mL in phosphate-buffered saline (PBS) with 12% OptiPrep™ Density Gradient Medium (Sigma). This cell mixture was used for microfluidic encapsulation. Approximately one million B cells from each of the six animals were run through an emulsion droplet microfluidics platform.

A DNA library encoding scFv from RNA of single cells, with native heavy-light Ig pairing intact, was generated using the emulsion droplet microfluidics platform or vortex emulsions. The method for generating the DNA library comprises the steps of 1) poly(A)+mRNA capture, 2) multiplexed overlap extension reverse transcriptase polymerase chain reaction (OE-RT-PCR), and 3) nested PCR to remove artifacts and add adapters for deep sequencing or yeast display libraries. The scFv libraries are generated from approximately one million B cells from each animal that achieved a positive titer.

For poly(A)+mRNA capture, a custom designed co-flow emulsion droplet microfluidic chip fabricated from glass (Dolomite) was used. The microfluidic chip has two input channels for fluorocarbon oil (Dolomite), one input channel for the cell suspension mix described above, and one input channel for oligo-dT beads (NEB) at 1.25 mg/ml in cell lysis buffer (20 mM Tris pH 7.5, 0.5 M NaCl, 1 mM ethylenediaminetetraacetic acid (EDTA), 0.5% Tween-20, and 20 mM dithiothreitol). The input channels are etched to 50 μm by 150 μm for most of the chip's length, narrow to 55 μm at the droplet junction, and were coated with hydrophobic Pico-Glide (Dolomite). Three Mitos P-Pump pressure pumps (Dolomite) were used to pump the liquids through the chip. Droplet size depends on pressure, but typically droplets of ~45 μm diameter were optimally stable. Emulsions were collected into chilled 2 ml microcentrifuge tubes and incubated at 40° C. for 15 minutes for mRNA capture. The beads were extracted from the droplets using Pico-Break (Dolomite). In some embodiments, similar single cell partitioning emulsions are made using a vortex.

For multiplex OE-RT-PCR, glass Telos droplet emulsion microfluidic chips were used (Dolomite). mRNA-bound beads were re-suspended into OE-RT-PCR mix and injected into the microfluidic chips with a mineral oil-based surfactant mix (available commercially from GigaGen) at pressures that generate 27 μm droplets. The OE-RT-PCR mix contains 2× one-step RT-PCR buffer, 2.0 mM $MgSO_4$, SuperScript III reverse transcriptase, and Platinum Taq (Thermo Fisher Scientific), plus a mixture of primers directed against the IgK C region, the IgG C region, and all V regions. The overlap region is a DNA sequence that encodes a Gly-Ser rich scFv linker sequence. The DNA fragments were recovered from the droplets using a droplet breaking solution (available commercially from GigaGen) and then purified using QIAquick PCR Purification Kit (Qiagen). In some embodiments, similar OE-RT-PCR emulsions were made using a vortex.

For nested PCR, the purified OE-RT-PCR product was first run on a 1.7% agarose gel for 80 minutes at 150 V. A band at 1200-1500 base pair (bp) corresponding to the linked product was excised and purified using NucleoSpin Gel and PCR Clean-up Kit (Macherey Nagel). PCR was then performed to add adapters for Illumina sequencing or yeast display; for sequencing, a randomer of seven nucleotides is added to increase base calling accuracy in subsequent next generation sequencing steps. Nested PCR was performed with 2×NEBNext High-Fidelity amplification mix (NEB) with either Illumina adapter containing primers or primers for cloning into the yeast expression vector. The nested PCR product was run on a 1.2% agarose gel for 50 minutes at 150V. A band at 800-1100 bp was excised and purified using NucleoSpin Gel and PCR Clean-up Kit (Macherey Nagel).

The OE-RT-PCR products were used as template in a nested PCR to add adapters for yeast surface display. *S. cerevisiae* cells (ATCC) were electroporated (Bio-Rad Gene Pulser II; 0.54 kV, 25 uF, infinite resistance) with the PCR product combined with a linearized vector for in vivo homologous recombination and inducible expression of scFv protein. Transformed yeast were expanded, induced with galactose, and approximately $2 \times 10^6$ induced yeast cells were stained with anti-c-Myc (Thermo Fisher Scientific) followed by a FITC-conjugated secondary antibody (Thermo Fisher Scientific), and biotinylated SARS CoV-2 RBD or Spike (1200 nM final concentration) followed by APC-streptavidin (Thermo Fisher Scientific); an scFv library specific for an unrelated target was used as a negative control. Yeast cells were then sorted (BD Influx) and 20-30× $10^3$ double-positive cells (FITC/APC+) were recovered. For further specificity, a second round of sorting using the same antigen was performed and $50 \times 10^3$ double-positive yeast was recovered.

The flow-sorted scFv were then subjected to sequencing (Illumina). Sequences identified using yeast scFv sorting with SARS-CoV-2 RBD are listed as Sequences 5083 through 6630, and sequences identified using yeast scFv sorting with SARS-CoV-2 Spike S1 are listed as Sequences 6631 through 8390. In some embodiments, sequences comprising Sequences 5083 through 8390 are used to generate an RPPs with binding and neutralization activity against SARS-CoV-2.

In certain embodiments, rCIG is an RPP comprising antibodies derived from one, two, four, eight, twelve, 50, or 100 mice. In certain embodiments, rCIG is an RPP comprising, 10, 100, 1,000, 10,000, 100,000, or more than 100,000 distinct antibody sequences. In certain embodiments, rCIG is an RPP comprising antibodies at various molar ratios, or antibodies comprising substantially similar molar ratios. In certain embodiments, these RPPs comprise therapeutics for COVID-19. In other embodiments, any single antibody from the RPP is used as a therapeutic for COVID-19. In certain embodiments, any single antibody or RPP is used as a therapeutic for any kind of coronavirus infection in human patients.

Example 2: Generation of RPP with Activity Against SARS CoV-2 from Convalescent COVID-19 Human Donors Overview Multiple rCIG (recombinant anti-coronavirus 19 hyperimmune gammaglobulin), i.e., RPP antibody pools with activity against COVID-19 antigens, were generated using B cells from convalescent COVID-19 donors. The sequence identifiers of the heavy and light chain CDR3 sequences are provided in Table 5, above, corresponding the sequences found in the sequence listing.

The rCIG drug is a fully recombinant IgG1/IgK polyclonal antibody preparation, comprising >1,000 unique antibody sequences at various ratios. The antibody sequences were derived from COVID-19 convalescent human donor peripheral blood mononuclear cells (PBMCs).

First, COVID-19 patients underwent IRB-approved consent at clinical sites, and approximately 50 mL of blood from each donor was obtained. Each sample was assessed for residual SARS CoV-2 using CDC qPCR assays. Additionally, each serum sample was tested for seroconversion using anti-SARS CoV-2 ELISA. The 16 high-titer convalescent COVID-19 donors were selected and custom microfluidics was used to capture natively paired antibody sequences from millions of donor B cells. The captured, natively paired, nucleic acid sequences were then expressed as yeast scFv libraries, and subjected to flow cytometry to enrich for binders against SARS CoV-2 RBD. Antibody nucleic acid sequences were purified from the sorted yeast clones and then engineered into full-length IgG1 antibody expression constructs, still retaining native pairing between heavy and light chain Ig.

The flow-sorted scFv were subjected to sequencing (Illumina). Sequences identified using yeast scFv sorting with SARS-CoV-2 RBD are listed as Sequences 1 through 4760, and sequences identified using yeast scFv sorting with SARS-CoV-2 Spike Slare listed as Sequences 4761 through 5082. In some embodiments, sequences comprising Sequences 1 through 5082 are used to generate an RPPs with binding and neutralization activity against SARS-CoV-2. In some embodiments, single antibodies comprising Sequences 1 through 5082 are used as a therapeutic for COVID-19, or any coronavirus infection in patients.

To convert the scFv libraries into full-length CHO expression libraries (RPPs), nested outer PCR primers were used to add adapters with overhangs for Gibson assembly to the 5' and 3' ends of the scFv library. Then NEBuilder HiFi DNA Assembly Master Mix (NEB, Ipswich, Mass., USA) was used to insert the scFv library into a vector containing a single promoter, a secretory leader sequence for light chain Ig and the remainder of the IgG1 constant region, creating a cloned scFv library. This intermediate library was transformed into *E. coli*, spread onto LB-ampicillin plates, 0.5-1 million colonies were scraped and pooled for a plasmid purification using ZymoPURE II Plasmid Maxiprep Kits (Zymo Research, Irvine, Calif., USA). To create the full-length antibody library, a second Gibson assembly was performed by linearizing the product of GA1 with BamHI-HF (NEB, Ipswich, Mass., USA) and using it as a vector to insert a synthetic amplicon containing a portion of the light chain Ig constant region, a poly(A) signal for light chain Ig, a promoter for the IgG gene and a secretory leader sequence for the IgG gene. The full-length library was then transformed into *E. coli* and spread on LB-ampicillin plates Over 0.5 million colonies are scraped and plasmid is purified with a ZymoPURE II Plasmid Maxiprep Kits (Zymo Research) to make the full-length recombinant hyperimmune maxiprep library for transfection.

The adherent Flp-In™-CHO cell line was adapted with a genomically integrated FRT site (Thermo Fisher Scientific, Waltham, Mass., USA) to suspension culture. For all steps in the adaptation process, "Ham's F-12" refers to Ham's F-12 (with L-glutamine, Thermo Fisher Scientific, Waltham, Mass., USA) plus 10% FBS (Thermo Fisher Scientific, Waltham, Mass., USA) and "BalanCD" refers to BalanCD CHO Growth A (Irvine Scientific) with 4 mM Glutamax (Thermo Fisher Scientific, Waltham, Mass., USA). To adapt this cell line to suspension, the cells were first passaged into a mixture of 50% Ham's F-12 plus 50% BalanCD in T-flasks. Cells were next passaged into 25% Ham's F-12 plus 75% BalanCD and switched to shaking Erlenmeyer flasks. Cells were then passaged into 10% Ham's F-12, 90% BalanCD+0.2% anti-clumping agent (Irvine Scientific, Santa Ana, Calif., USA) and banked for future use.

100 million of the adapted Flp-In CHO cells were transfected per recombinant hyperimmune library using an Amaxa Nucleofector 4D (SG buffer, pulse DU133; Lonza, Basel, Switzerland). These cells were plated into shaking Erlenmeyer flasks and recovered in an incubator at 37° C. and 125 rpm for 48 hours. After 48 hours, the cells were counted to determine viability, cells were seeded at 1 million cells/mL, and selection was started using 600 μg/mL Hygromycin-B (Gemini Bio, West Sacramento, Calif., USA) in fresh media. Cells were counted and media was changed every 2-3 days during the 7-day selection. The libraries were kept on 600 μg/mL Hygromycin-B (Gemini Bio, West Sacramento, Calif., USA) during expansion until viability exceeded 95%. When cells were >95% viable and doubling every 24 hours, the cell line was banked for liquid nitrogen storage.

CHO cells stably expressing antibody libraries were grown in media consisting of 90% BalanCD CHO Growth A Medium (Irvine Scientific, Santa Ana, Calif.), 9% Ham's F-12 (Thermo Fisher Scientific, Waltham, Mass., USA), 1% FBS (ThermoFisher Scientific), 4 mM Glutamax (Thermo Fisher Scientific, Waltham, Mass., USA), 0.2% anti-clumping agent (Irvine Scientific, Santa Ana, Calif., USA). For small-scale production, cells were seeded at $1 \times 10^6$ cells/mL into 50 mL media in a 250 mL Erlenmeyer flask and grown at 37° C., 5% $CO_2$, 125 rpm. Cells were continually grown under these conditions and supplemented with 7.5 mL CHO Feed 1 (Irvine Scientific, Santa Ana, Calif., USA) on days 2, 4 and 7 of the production run. Supernatant was harvested on Day 8 by centrifugation followed by filtration through a 0.22 μm 250 mL filter bottle (EMD Millipore, Burlington, Mass., USA) with 1 μm pre-filter (EMD Millipore, Burlington, Mass., USA). Harvested cell culture fluid (HCCF) was stored at 4° C. until Protein A purification. For large-scale production of the plasma cell recombinant hyperimmune, cells were grown in the same media but with some modifications to the production conditions. A seed train was used to scale the cultures from $2 \times 10^7$ cells to $1.2 \times 10^{10}$ cells at 37° C. Cells were then seeded at $1 \times 10^6$ cells/mL in 2 L in a 5 L flask (in triplicate; Day 0). On Day 2 the temperature was shifted from 37° C. to 33° C. Each flask was fed with 300 mL CHO Feed 1 (Irvine Scientific, Santa Ana, Calif., USA) on days 2, 4, 6, 8, 10, and 13 of the culture. Supernatant was harvested on Day 14.

After harvest, HCCF was purified with Mab Select SuRe Protein A resin (GE Life Sciences, Marlborough, Mass., USA) using the following buffers: Equilibration, Chase, Wash 2 (25 mM Tris, 150 mM NaCl, pH 7.4), Wash 1 (25 mM Tris, 1 M NaCl, pH 7.4), Elution (20 mM citric acid, pH 3.0), Neutralization (100 mM Tris, pH 8.0 for small scale, 1 M Tris, pH 9.0 for large scale). The column was sanitized before and after use with 0.1 N NaOH. For the large-scale production of the plasma cell recombinant hyperimmune, an additional Wash 3 consisting of 0.5 M arginine, pH 7.4 was used, followed by an additional wash with Wash 2 before elution. The order of purification steps was: Equilibration, Load, Chase, Wash 1, Wash 2, (large scale: Wash 3, Wash 2), Elution, Neutralization (added manually into tubes used for collection of eluate fractions). The recombinant hyperimmunes (RPPs) were concentrated using Vivaspin 20, 30 kDa molecular weight cut off spin concentrators (Sartorius, Gottingen, Germany) and formulated in PBS (small-scale productions) or 0.2 M glycine, pH 4.5 (large scale production), followed by 0.22 μm filtration.

This processed resulted in integration of a single heavy-light chain-paired transgene into the genomic FRT site of individual CHO cells, creating cell pools, or "research cell banks" (RCBs). In certain embodiments, these RCBs are combined to create a CHO polyclonal master cell bank (MCB).

In certain embodiments, rCIG is an RPP comprising antibodies derived from one, two, four, eight, twelve, 50, or 100 human donors. In certain embodiments, rCIG is an RPP comprising, 10, 100, 1,000, 10,000, 100,000, or more than 100,000 distinct antibody sequences. In certain embodiments, rCIG is an RPP comprising antibodies at various molar ratios, or antibodies comprising substantially similar molar ratios. In certain embodiments, these RPPs comprise therapeutics for COVID-19. In other embodiments, any single antibody from the RPP is used as a therapeutic for COVID-19. In certain embodiments, any single antibody or RPP is used as a therapeutic for any kind of coronavirus infection in human patients.

Upstream GMP manufacturing is carried out using this MCB and standard GMP protocols in single-use fed-batch bioreactors. The rCIG protein is purified with Protein A resin and standard downstream recombinant antibody processing steps, including anion and cation exchange, viral inactivation and filtration, and diafiltration/ultrafiltration (DF/UF). Viral clearance studies and full MCB characterization are performed. A plasma-derived IVIG is used as a reference control for protein quality assessment. Plasma-derived IVIG is the best available reference control, since it comprises a diverse set of antibodies, like rCIG, and serves as a baseline for an immunoglobulin that is not highly reactive against SARS CoV-2. Lot release assays include a battery of assays typically used to assess purity, such as SEC HPLC, CE-SDS, host cell protein, and potency, such as anti-SARS CoV-2 ELISA. Anti-SARS CoV-2 ELISA, SEC HPLC, and CD-SDS is used to infer identity.

Quantitative PCR (qPCR) is used to confirm the absence of SARS CoV-2 RNA present in donor PBMCs.

Host Cell Line Development

A large-scale screen was performed to identify a parental host cell clone for targeted integration of rCIG expression construct libraries.

Figure 1:
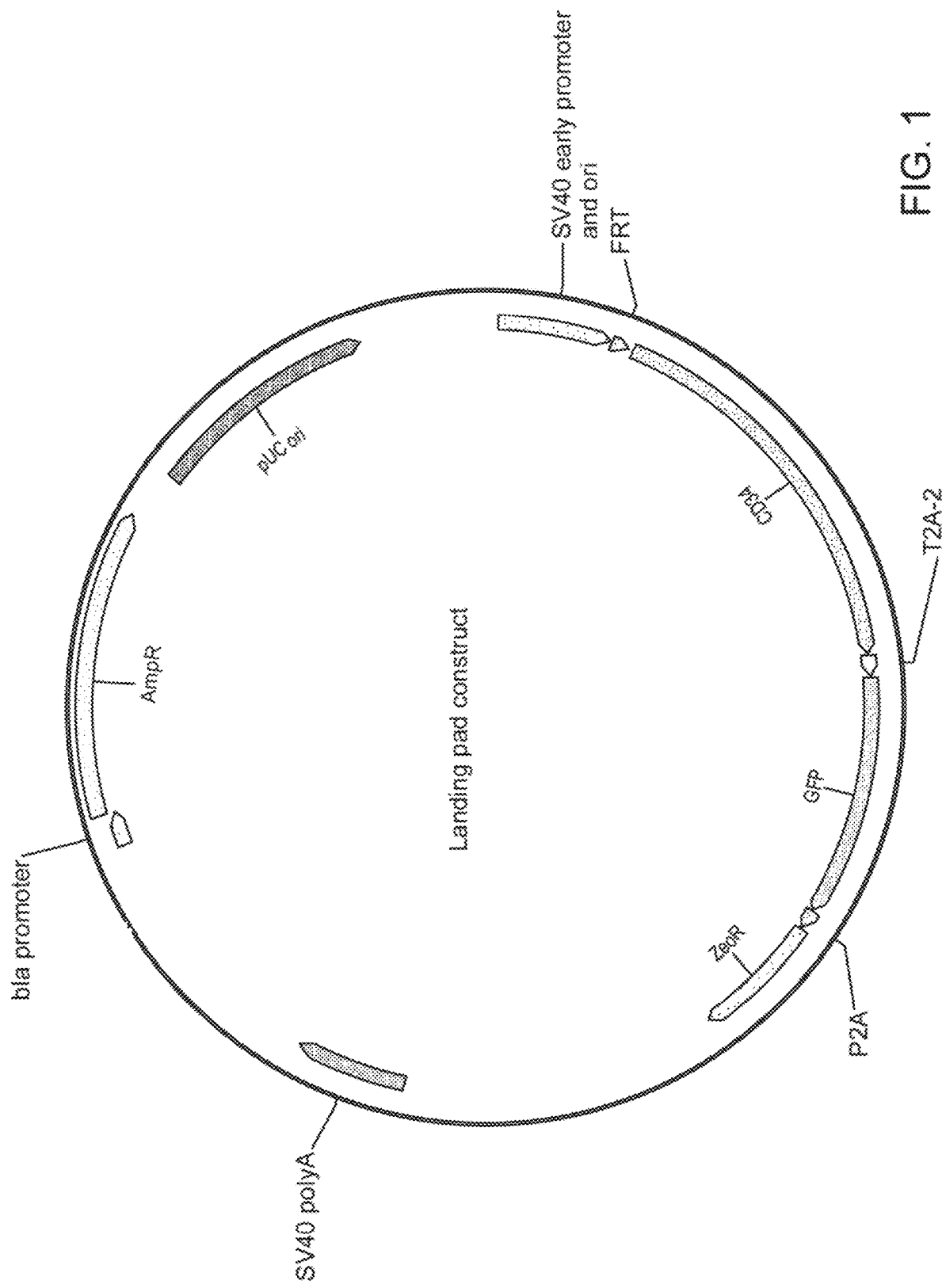

First, a landing pad construct (PMD-4681) was designed and synthesized. PMD-4681 was based on pFRT-lacZeo (ThermoFisher), with some modifications (FIG. 1). In place of the LacZ expression construct a cassette was inserted coding for expression of CD34 and GFP. The CD34, GFP, and downstream Zeocin resistance genes (ZeoR present in original plasmid) were separated by 2A motifs (T2A-2 or P2A) to allow for translation of three separate polypeptide chains. The CD34 sequence was sourced as a gBlock from IDT. The GFP sequence was sourced from ATUM (DasherGFP).

The GMP suspension CHO line CHOZN® GS−/− was obtained from Sigma Aldrich. Cells were sent to Bionova Scientific (Fremont, Calif.) to generate a working cell bank (WCB). A vial of cells from the WCB was thawed from LN2 and expanded. PMD-4681 was linearized using a restriction enzyme and purified via ethanol precipitation. Cells were then transfected with the FRT-GFP-Zeocin landing pad by random integration using Lonza's Nucleofector™ 4D, SE kit. Cells recovered overnight in an incubator and were plated the next day into minipools at 5,000 cells per well, across ten 96-well plates in selective media. The remaining cells were plated and selected together as a bulk pool control. Wells were fed every seven days until at least 80% confluency was reached.

A total of 236 minipools grew out and were screened in parallel for high GFP expression via flow cytometry and low copy number with a Copy Number Variation assay (CNV). Minipools with a copy number less than 2.5 and GFP expression at least 50% of the bulk pool were expanded into shaking adaptation. Expanded pools were also re-tested for GFP expression and confirmed via flow cytometry. Once minipools were expanded, vial aliquots were frozen down.

Minipool vials were thawed and allowed to recover. Cells were then adapted to a liquid counterpart of the semisolid media used for single cell cloning. Minipools were deemed fully adapted when cells would show consistent doubling times and high viability (>90%). Adapted cells were then plated into semisolid media for the Molecular Devices ClonePix3 single cell cloning platform. Single cell imaging was obtained on day 0 of cell plating in semisolid media to confirm monoclonality. Clonal cell colonies reached outgrowth in fourteen days. Clonal cell colonies were picked and deposited as one colony per well of a 96-well plate. Each clone was then expanded, re-adapted to selection media, and cryopreserved. Doubling times were calculated and clones with less than a 30-hour doubling time were chosen for further development. Expanded clones were retested for GFP expression and copy number.

Each clone was then transfected in duplicate using the BioRad Gene Pulser Xcell™ Total System with a monoclonal antibody (mAb)-cyan fluorescent protein (CFP) construct to test expression titer. Transfection conditions were optimized such that clonal lines were >90% viable at time of transfection and at least >70% viable post-transfection. CFP expression was evaluated via flow cytometry 3 days post transfection to determine relative transfection efficiency >35%. After full selection and recovery, cell lines were tested in a 10-day TPP (bioreactor tubes) shaking production run in duplicate. Titers for candidate cell lines ranged 50-100 mg/L. A single clone (CSS-1286) derived from minipool CSS-1144 was selected for further development.

Agilent SureSelect was used to confirm the number of copies and genome location of the landing pad in CSS-1286. SureSelect enriches for a targeted area of interest within the CHO genome and allows for high throughput sequencing using Illumina. In this case, the landing pad site was targeted for enrichment using custom probes.

Genomic DNA was extracted from CSS-1286 and fragmented for sequencing. Complementary oligonucleotide probes ("baits"), were designed to enrich target DNA sequences. When exposed to the genomic DNA library, the baits bound to the sequence of interest and were pulled down via magnetic bead enrichment. Illumina sequencing adapters were then added to the enriched DNA fragments and amplified via PCR, resulting in an enrichment of the fragments of interest. Fragments were analyzed on an Illumina MiSeq.

The data were analyzed using the Horizon Discovery CHO genome sequence as a reference. Sequences were mapped to the reference landing pad sequence. Any chimeric reads, sequences containing both partial landing pad sequences and CHO genome sequences were extracted and mapped back to the CHO genome. This allowed for identification of where the landing pad had inserted into the CSS-1286 genome.

To confirm copy number using an orthogonal method, CSS-1286 was sent to Cergentis for Targeted Locus Amplification (TLA) (Hottentot et al., 2007). Targeted DNA sequences close in physical space were crosslinked. The targeted sequences were then digested and then ligated back together, forming circles of DNA. Inverse PCR was performed, using the targeted sequence as the initial binding region for amplification. This created large libraries of DNA that were then be sequenced using Illumina sequencing. Sequences were then mapped back to the reference Horizon Discovery CHO genome to determine copy number and genome integration location. TLA and SureSelect identified the same single genome location.

Antibody Library Cloning

Figure 2A:
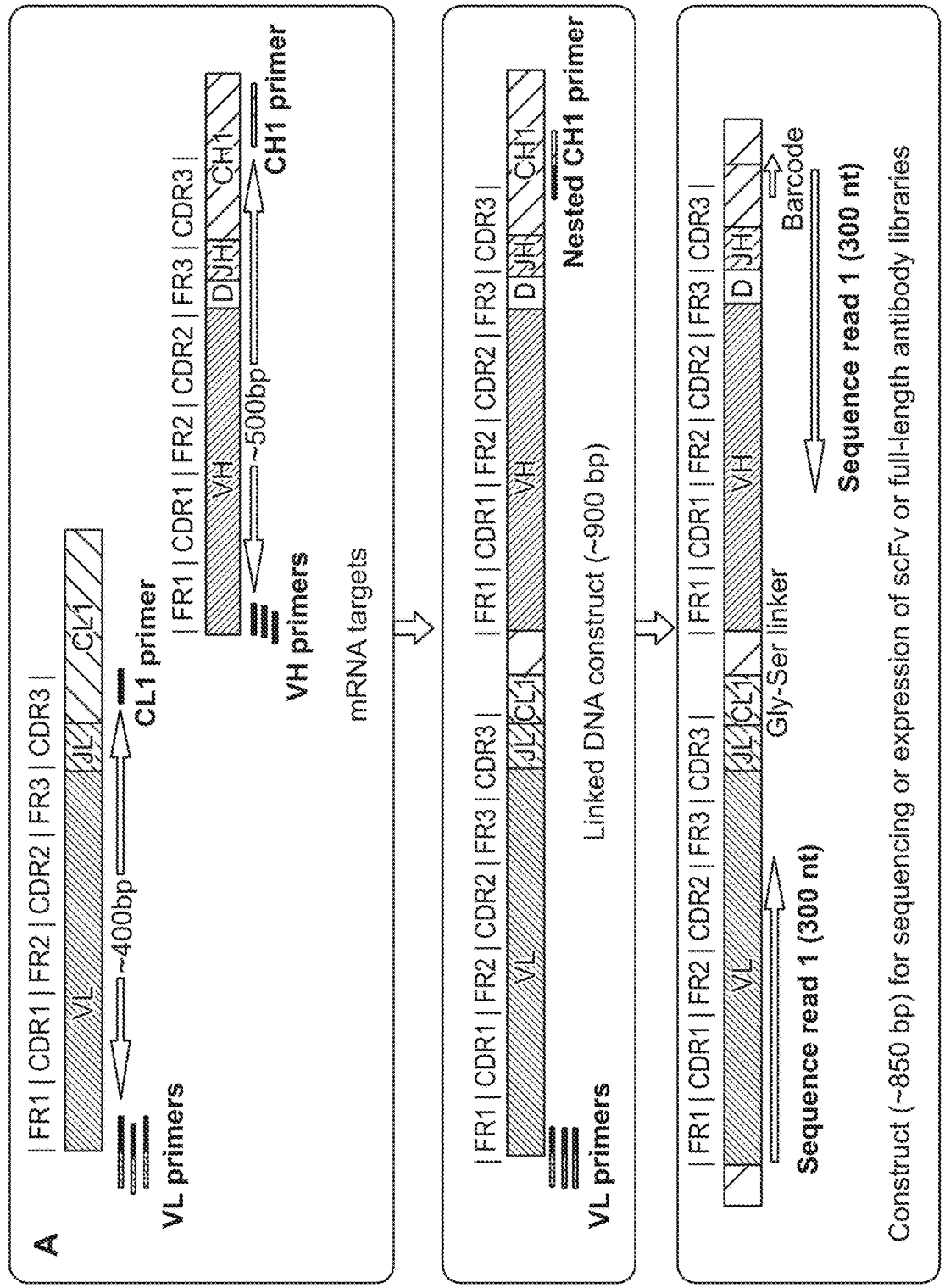
Figure 2B:
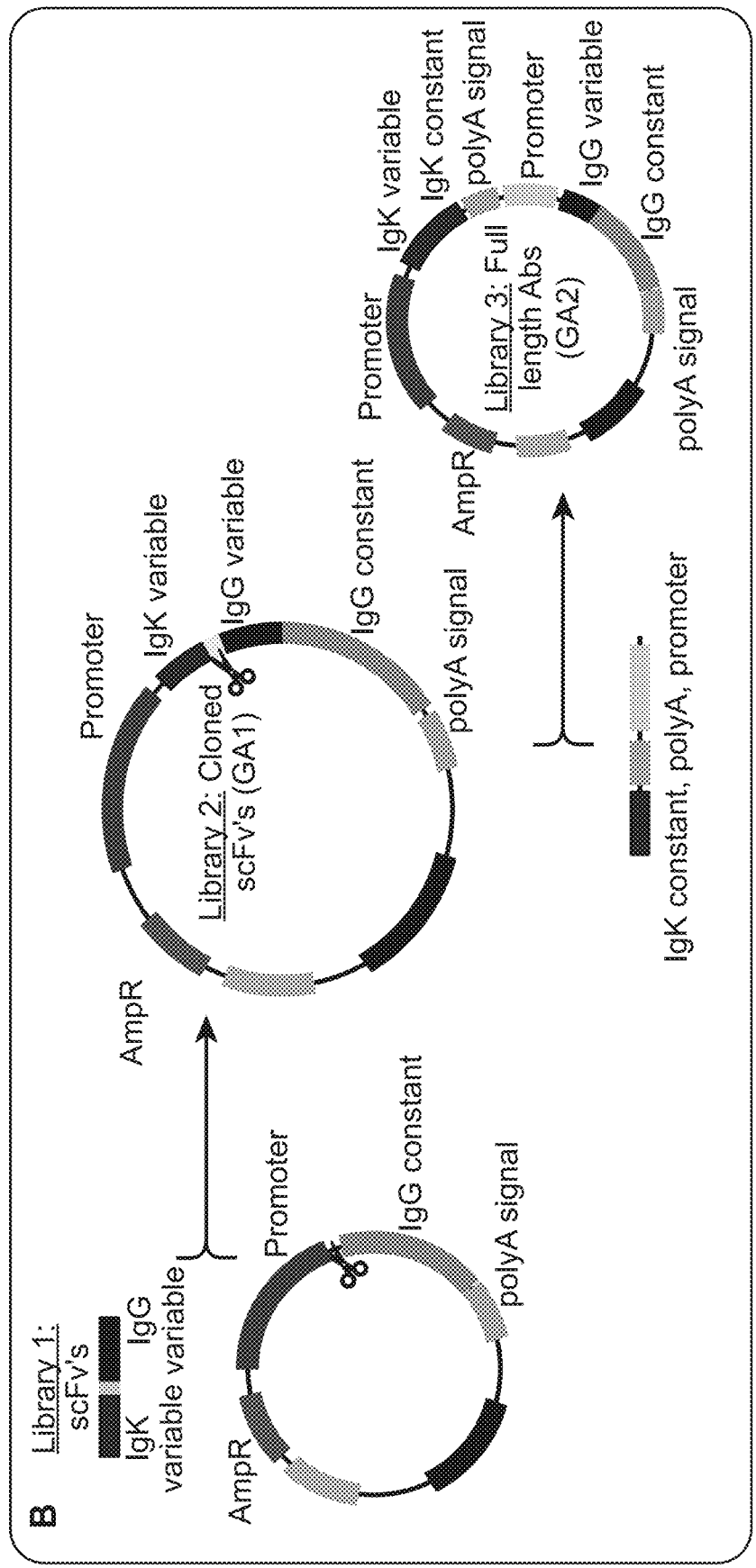

Generation of amplicon libraries comprised three steps: (i) poly(A)+ mRNA capture, (ii) multiplexed overlap extension reverse transcriptase polymerase chain reaction (OE-RT-PCR), and (iii) nested PCR to remove artifacts and add adapter sequences for Illumina sequencing or cloning into antibody expression vectors (FIGS. 2A and 2B).

First, PBMCs were collected from 50 human donors (median age 52; range 20-71), either presumed positive by symptoms or confirmed positive by nasal swab test (Roche) at the collection site. No follow-up nasal swab qPCR assay was required to show viral clearance. The median days since onset of symptoms was 23 days (range 12-42). Donors were consented under an IRB protocol by a CRO and shipped to GigaGen overnight at ambient temperature. The serum fraction was isolated for each of the 50 donors. Each serum was assayed for reactivity against SARS CoV-2 Spike protein and SARS CoV-2 RBD protein, using ELISA (FIGS. 3A-3D). 33 of the donors bound to Spike and/or RBD. The 16 highest titer donors were then selected for library generation (Library 1 to 8).

Next, PBMC samples from each of the 16 "high titer" donors were assayed the for SARS CoV-2 virus using CDC qPCR assays (FIGS. 3A-3D). None of the 16 donors showed any detectable SARS CoV-2 RNA. 1.5-2 million B cells were isolated from each of the 16 high titer donors into fluorocarbon oil (Dolomite) emulsion microdroplets with lysis buffer (20 mM Tris pH 7.5, 0.5 M NaCl, 1 mM EDTA, 0.5% Tween-20, and 20 mM DTT) and oligo(dT) beads (New England Biolabs Inc.; NEB), using an emulsion droplet microfluidic chip. Typically, >3 million single cells were processed per hour, with >99% of cell-containing droplets containing single cells. Beads were separated from the droplets using Pico-Break solution (Dolomite). Multiplex OE-RT-PCR was then performed in emulsions, using purified RNA-bound beads as template, to generate single chain variable fragment (scFv) amplicons that linked the heavy and light chain Ig from single B cells (Adler et al., 2017). Pools of 2 high titer donors were amplified in the emulsions, for a total of 8 emulsion reactions.

The OE-RT-PCR products were used as template in a nested PCR to add adapters for yeast surface display. *S. cerevisiae* cells (ATCC) were electroporated (Bio-Rad Gene Pulser II; 0.54 kV, 25 uF, infinite resistance) with the PCR product combined with a linearized vector for in vivo homologous recombination and inducible expression of scFv protein. Transformed yeast were expanded, induced with galactose, and approximately $2 \times 10^6$ induced yeast cells were stained with anti-c-Myc (Thermo Fisher Scientific) followed by a FITC-conjugated secondary antibody (Thermo Fisher Scientific), and biotinylated SARS CoV-2 RBD or Spike (1200 nM final concentration) followed by APC-streptavidin (Thermo Fisher Scientific); an scFv library specific for an unrelated target was used as a negative control. Yeast cells were then sorted (BD Influx) and 20-30× $10^3$ double-positive cells (FITC/APC+) were recovered. For further specificity, a second round of sorting using the same antigen was performed and 50×$10^3$ double-positive yeast 2-donor library were recovered.

An average of 1.1% of the expressed antibodies were RBD-specific after the first sort, suggesting that most antibodies in the original convalescent COVID-19 repertoires are not specific to SARS CoV-2. Plasmid scFvs from each of the 8 sorted libraries were subjected to PCR to amplify the scFv and add adapters for Illumina sequencing. A randomer of seven nucleotides was added to increase base calling accuracy in subsequent Illumina sequencing steps. Sequencing on a MiSeq (Illumina) showed that each sorted library comprised a median of 129 antibodies (range: 83 to 209).

Figure 4:
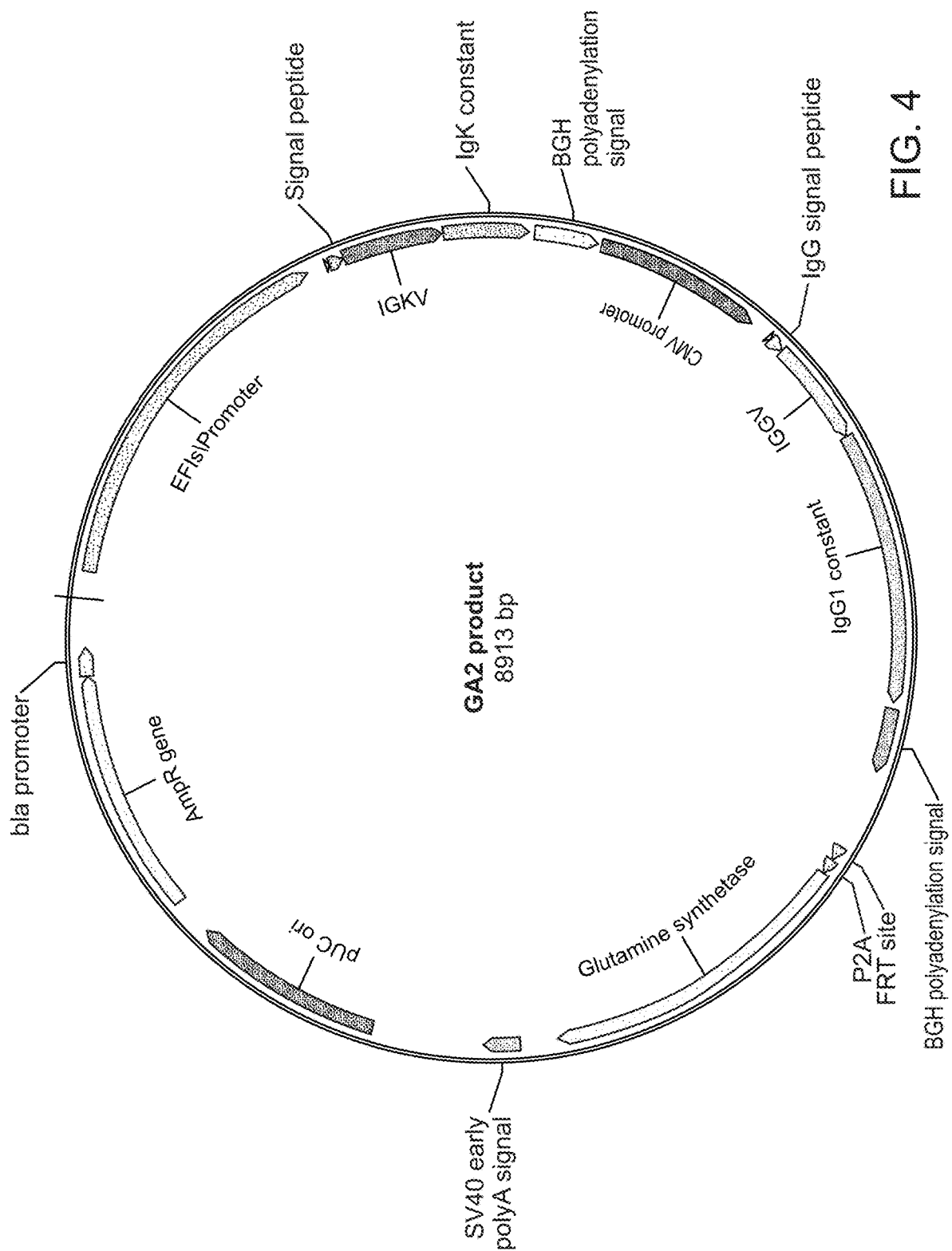
FIG. 4 illustrates a map for a fully assembled antibody expression plasmid.
Figure 7A:
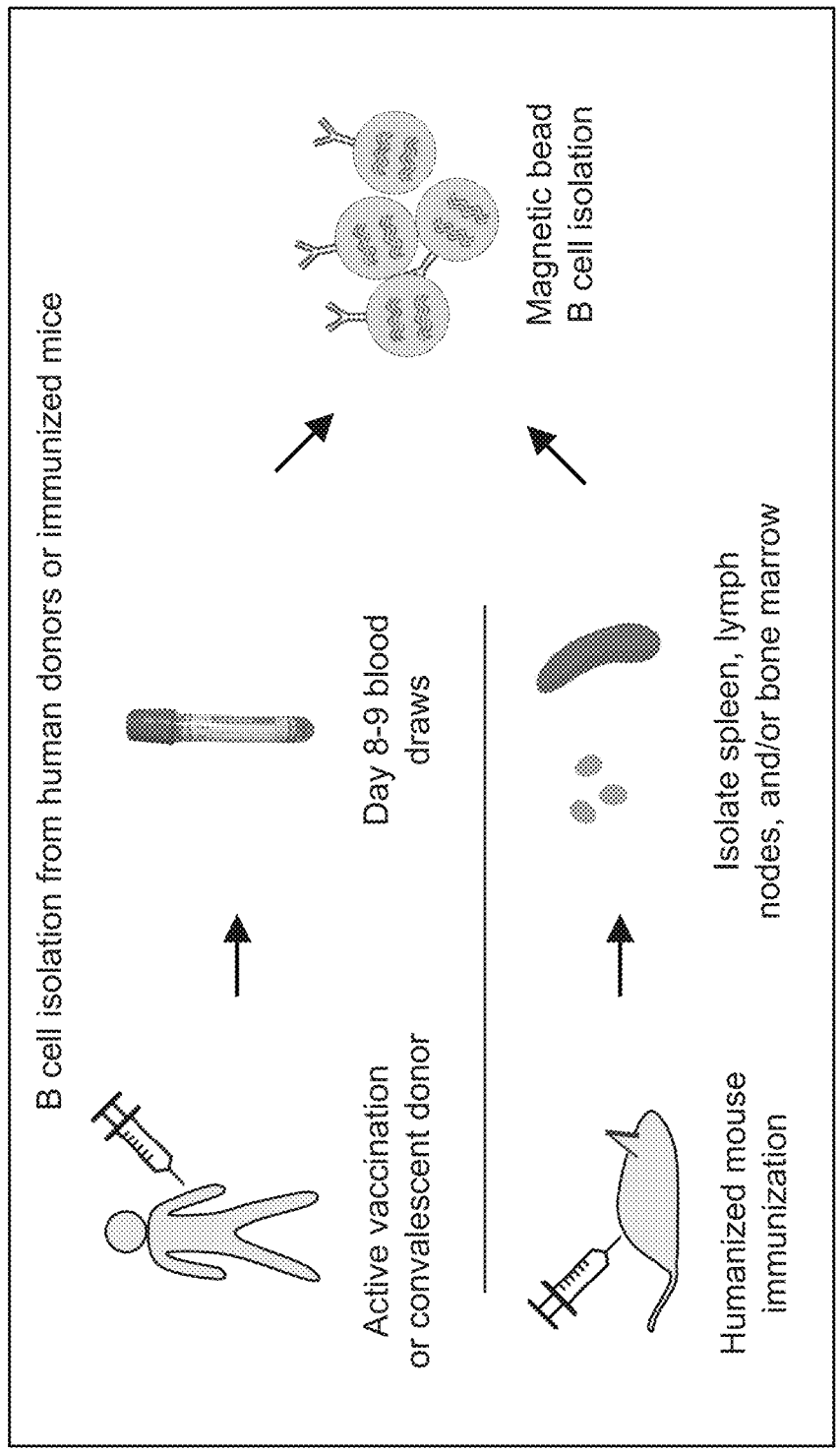
FIG. 7A illustrates the process of isolating B cells from human donors (vaccinated or convalescent) or immunized humanized mice.
Figure 7B:
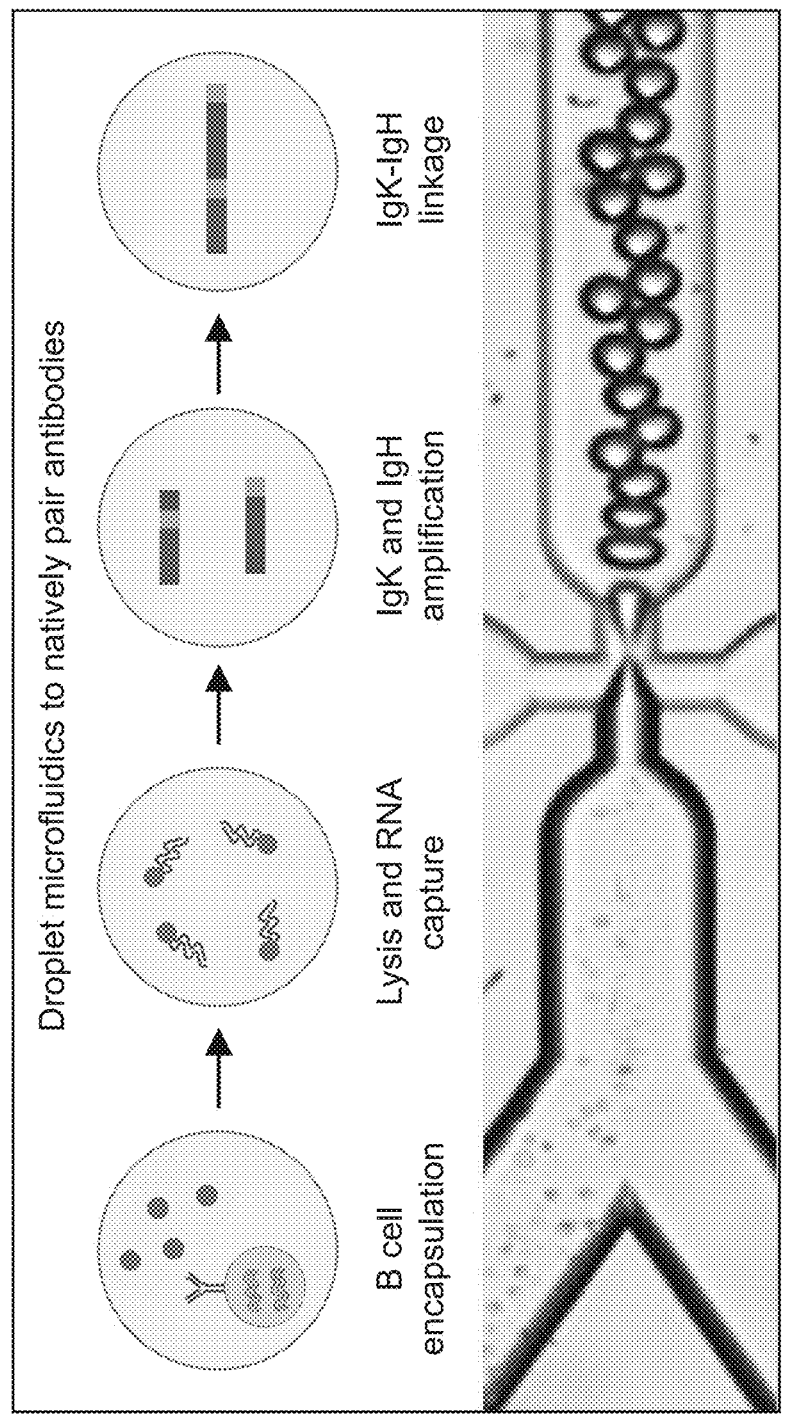
FIG. 7B illustrates the process of capturing natively paired antibody sequences from millions of single cells using droplet microfluidics.
Figure 7C:
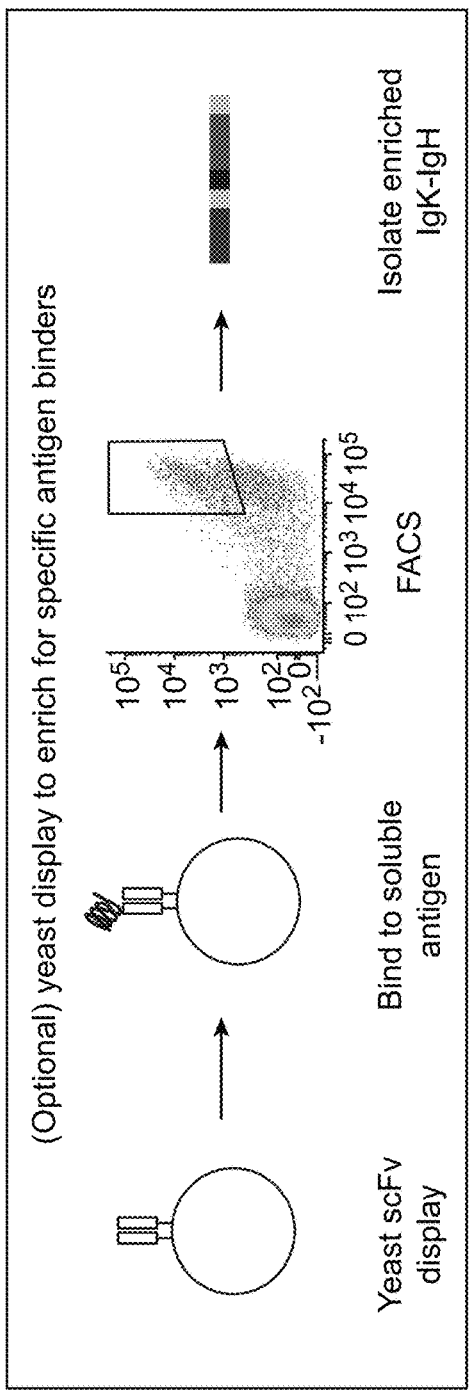
FIG. 7C illustrates the process of enriching binders to a soluble antigen using a yeast scFv display system.
Figure 7D:
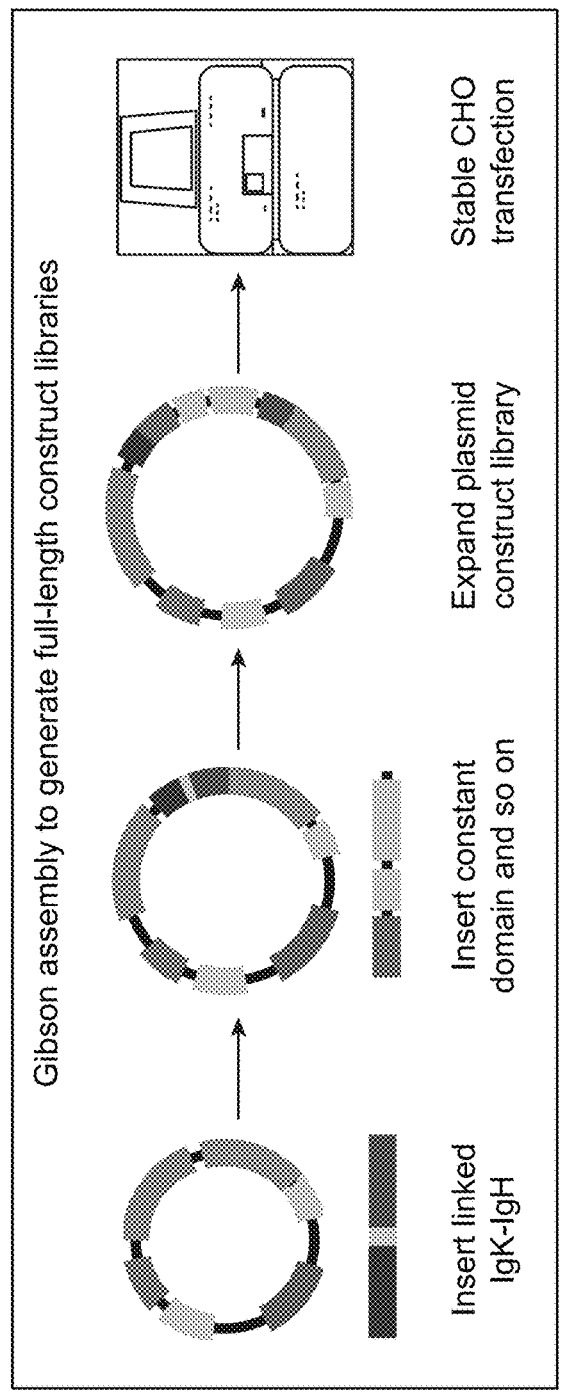
FIG. 7D illustrates the two-step process comprising (i) Gibson assembly of converting the scFv fragment to full-length antibody expression constructs and (ii) stably integrating the constructs into CHO cells following electroporation and selection.
Figure 7E:
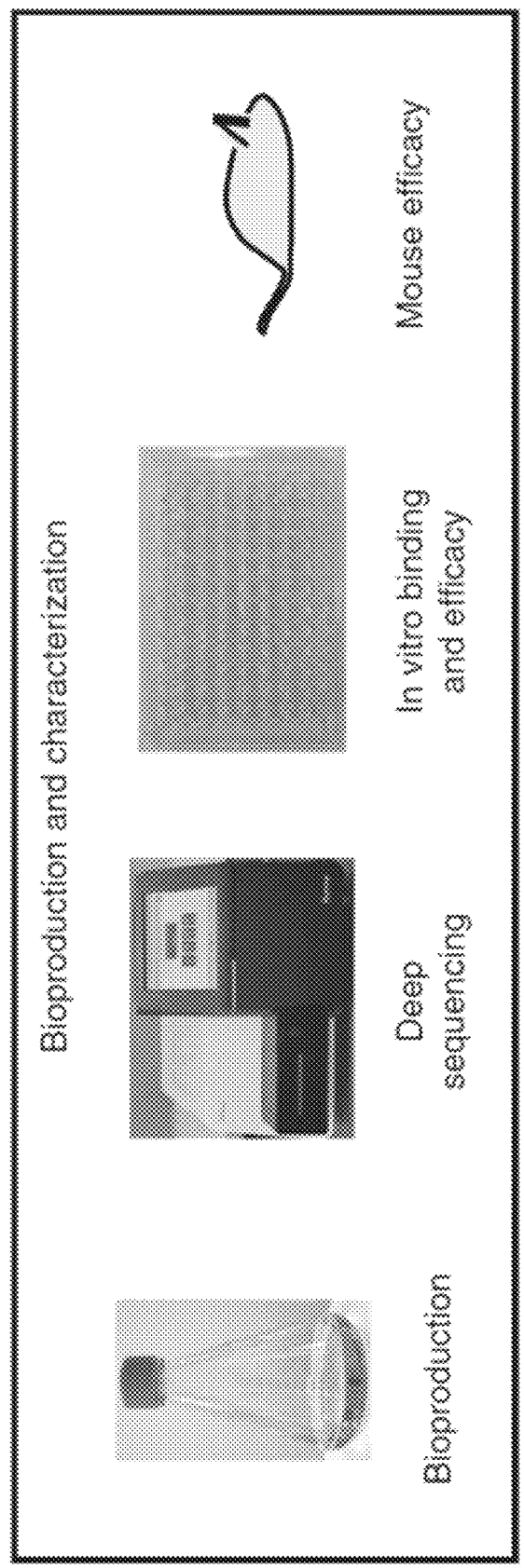
FIG. 7E illustrates bioproduction and characterizations. The libraries were characterized by deep sequencing, in vitro binding and efficacy assays, and/or in vivo mouse efficacy studies.

To convert the 8 sorted scFv libraries into full-length antibody libraries, a cloning pipeline was developed to convert the 8 scFv libraries into full-length CHO expression libraries (FIG. 4). First, nested outer PCR primers added adapters with overhangs for Gibson assembly to the 5' and 3' ends of the scFv library. Then Gibson Assembly (NEB) was used to insert the scFv library into a vector containing a single promoter, a secretory leader sequence for light chain Ig and the remainder of the IgG constant region, creating a cloned scFv library. To create the full-length antibody library, another Gibson Assembly was used to insert a synthetic amplicon containing a portion of the light chain Ig constant region, a poly(A) signal for light chain Ig, a promoter for the IgG gene and a secretory leader sequence for the IgG gene.

The base plasmid for antibody expression was derived from pCDNA5/FRT (ThermoFisher), with some modifications (FIG. 4). The original plasmid (purchased from ThermoFisher) contained a CMV promoter followed by the protein open reading frame and finally a BGH polyadenylation sequence. The assembled antibody expression plasmid (after the second Gibson Assembly) contains an EF1-alpha promoter (sourced from pEF1a-IRES, Takara Bio), followed by an *H. sapiens* IgG signal peptide, the IgK variable region sourced from the donor B cell, and the IgK constant region. Next is a BGH polyadenylation sequence (same sequence as in the original plasmid), followed by the CMV promoter (from the original plasmid), the IgG signal peptide, IgG variable region sourced from the donor B cell, IgG constant region and a second BGH polyadenylation sequence (from the original plasmid). The hygromycin resistance gene in the original plasmid was replaced with the glutamine synthetase gene (sourced from pCGS3, MilliporeSigma) preceded by a 2A motif.

The full-length rCIG plasmid libraries were then transformed en masse into *E. coli* and then spread on LB-carbenicillin plates. >1 million colonies were typically scraped and plasmid was purified with a Maxi prep kit (Qiagen) to make the full-length Maxi prep library, which was then transfected into parental CHO cells, as described below. RCB and MCB Generation The 8 full-length rCIG library maxipreps were used to create 8 polyclonal RCBs, which could be used to produce RPP. First, a vial from the bank of parental CSS-1286 cells was thawed out and recovered. CSS-1286 cells were taken off Zeocin selection the day before transfection. CSS-1286 cells were co-transfected with the full-length rCIG library maxiprep and a recombinase plasmid using the Gene Pulser Xcell™ Total System in growth media. The host cell then expresses the Flp recombinase off the recombinase plasmid to promote recombination of each donor full-length rCIG library into the landing pad site of CSS-1286. Transfected cells were recovered in static flasks for 72 hours at 37° C., 5% $CO_2$ and then subjected to GS selection to produce stable pools of cells expressing rCIG antibodies. The cells were provided a media change with selective media every seven days for approximately 14 days until fully selected.

The selected cells were expanded and cryopreserved, generating 8 polyclonal rCIG RCBs, which could be used to produce RPP. Small-scale production of RPP in shake flasks was performed for each rCIG RCB, and the protein products were subjected to a battery of tests, including anti-SARS CoV-2 ELISA and a Spike:ACE2-inhibition ELISA. The anti-SARS CoV-2 binding ELISA showed that the scFv-sorted rCIG products were typically >10,000-fold more potent than plasma-derived IVIG, and ranged from 147- to 1,394-fold more potent binding than matched convalescent serum/plasma. The potential for SARS CoV-2 neutralization was assessed using a Spike:ACE2-inhibition ELISA and pseudotype neutralization assays. Preliminary results showed that neutralization was generally consistent between the ELISA and pseudotype neutralization methods. Plasma-derived IVIG showed no detectable neutralization. The scFv-sorted rCIG library products were 32.7-1,500-fold more potent than matched convalescent serum/plasma, generally consistent with the trends observed in the anti-SARS CoV-2 binding ELISA experiments. No library that was tested showed anti-RBC agglutination or anti-HLA reactivity.

A mixture of the 8 RCBs is prepared to generate an MCB for GMP production of RPPs, simultaneously maximizing antibody diversity and neutralizing activity, while retaining low off-target reactivity. The mixture of RCBs is generated by thawing the chosen RCBs and then mixing them at a predetermined ratio, i.e., not necessarily in equivalent ratios. A panel of assays is used to characterize rCIG drug candidate produced at small scale from the mixture of RCBs (FIGS. 5 and 6). The MCB is characterized using standard assays, including mycoplasma, adventitious viruses, hamster antibodies, and sterility. The MCB is also assessed for phenotypic stability using a standard cell aging protocol.

Bioproduction of rCIG

The MCB are expanded in a seed train. The seed train is used to inoculate large-scale bioreactors, for example, 200 L single use bioreactors (SUBs). Bioproduction of RPP is monitored for a variety of parameters, including viability, IgG titer, glucose, and metabolites. Bioproduction continues for 14 days or until cell viability drops below 80%. The harvested cell culture fluid (HCCF) is then be used for downstream purification.

The GMP downstream process is designed to selectively purify antibody from the harvested cell culture fluid (HCCF), and then further polish the material by removing residual host cell protein (HCP), aggregate, and other impurities. DNA and virus are also inactivated and removed, and the final material is formulated at the desired concentration in the final buffer.

The steps of downstream production include, e.g., standard Protein A purification; subjecting the eluant to a pH 3.5 hold for viral inactivation; and polishing using cation-exchange (CEX), anion-exchange (AEX), and viral clearance filters; ultrafiltration/diafiltration (UF/DF) and sterile filtration for final formulation of the drug substance.

Antibody RNA Sequencing for Process Monitoring

Currently, no technology exists to reliably quantify the individual protein components of mixtures of more than 1,000 proteins. As such, the individual antibody protein components of plasma-derived antibody products such as IVIG remain unknown. Using current technologies, antibody sequencing can only be performed on individual purified proteins, such as monoclonal antibodies. Therefore, lot release metrics for plasma-derived antibody products do not include antibody sequencing.

Like plasma-derived antibody products, rCIG comprise >1,000 different antibodies. Unlike plasma-derived antibody products, rCIG is manufactured from a CHO master cell bank that expresses RNA that encodes >1,000 different antibodies. Unlike protein sequencing, sequencing of RNA mixtures is technologically mature, very high-throughput, and quantitative. Therefore, Illumina sequencing of antibody RNA ("antibody RNA-seq") expressed by CHO cells is used as a method to assesses antibody diversity at the end of bioproduction.

Small-scale (2.5-5 L) engineering runs are used to establish control ranges in the Jaccard and Morisita indices (Rempala & Seweryn, 2013) between the MCB and harvest day. The Jaccard metric assesses the overlap of antibody sequences between two given samples, whereas the Morisita index assesses the quantitative consistency of antibody sequences between two given samples. Thus, Jaccard assesses maintenance of antibody diversity, and Morisita assesses maintenance of antibody frequencies.

Sufficient replicates are performed to generate a median and standard deviation for Jaccard and Morisita indices from production runs that produce protein product above a critical minimal cutoff for rCIG potency. These ranges are used to monitor and assess GMP manufacturing at the 200 L scale.

Example 3: Generation of Recombinant Hyperimmune Globulins from Diverse B-Cell Repertoires Plasma-derived polyclonal antibody therapeutics, such as intravenous immunoglobulin, have multiple drawbacks, including low potency, impurities, insufficient supply and batch-to-batch variation. The present disclosure describes a microfluidics and molecular genomics strategy for capturing diverse mammalian antibody repertoires to create recombinant multivalent hyperimmune globulins. The method generates of diverse mixtures of thousands of recombinant antibodies, enriched for specificity and activity against therapeutic targets. Each hyperimmune globulin product comprised thousands to tens of thousands of antibodies derived from convalescent or vaccinated human donors or from immunized mice. Using this approach, Applicant generated hyperimmune globulins with potent neutralizing activity against severe acute respiratory syndrome coronavirus-2 (SARS-CoV-2) in under 3 months, Fc-engineered hyperimmune globulins specific for Zika virus that lacked antibody-dependent enhancement of disease, and hyperimmune globulins specific for lung pathogens present in patients with primary immune deficiency. To address the limitations of rabbit-derived anti-thymocyte globulin, Applicant generated a recombinant human version and demonstrated its efficacy in mice against graft-versus-host disease.

The technology described here generates recombinant hyperimmune globulins for diverse conditions through high-throughput microfluidics, genomics and mammalian cell engineering. B cells from human donors or mice are run through a microfluidic platform, heavy and light chain immunoglobulin nucleic acid sequences are fused on a single-cell level to create antibody repertoires, antibody repertoires are engineered into full-length expression constructs en masse, and then the full-length antibody expression constructs are stably introduced en masse into Chinese hamster ovary (CHO) cells in a site-directed manner. The technology disclosed herein was applied to develop $10^3$ to $10^4$ diverse recombinant hyperimmune globulin drug candidates to address unmet clinical needs for the COVID-19 pandemic, Zika virus disease, primary immune deficiency (PID) and transplant tolerance. The drug candidates were validated in vivo and/or in vitro for each of the four clinical applications.

Results

Capturing Diverse Antibody Repertoires as CHO Libraries and RPPs

Mammalian antibody repertoires are extremely diverse, comprising as many as $10^7$ antibody clonotypes. Advanced molecular technology is required to capture a substantial fraction of a mammalian donor's diverse antibody repertoire. Applicant used methods for generating millions-diverse libraries of natively paired heavy and light chain immunoglobulin sequences in yeast. That method used microfluidics to isolate millions of single B cells per hour into picoliter droplets for lysis, followed by overlap extension-reverse transcriptase-polymerase chain reaction (OE-RT-PCR), to generate libraries of natively paired single chain variable fragments (scFv).

Because antibody repertoires often contain many antibodies not directed against the target(s) of interest, a variety of enrichment methods (FIG. 7A-7E) were used. For ATG, Zika virus, *Haemophilus influenzae* b (Hib) and *Streptococcus pneumoniae* (pneumococcus), immunogens were administered to human donors or humanized mice before sampling antibody-producing cells. For SARS-CoV-2, convalescent donors were recruited who recently tested positive for COVID-19, made yeast display scFv libraries from donor B cells and sorted the libraries derived from these donors to enrich for antibodies directed against SARS-CoV-2 antigen. In all cases, the output was a library of thousands to tens of thousands of natively paired scFv DNAs, enriched for activity against their respective target(s).

Next, each library of scFv DNAs was used to produce natively paired full-length antibody expression constructs, which were then engineered into mammalian cells for production of recombinant hyperimmune globulins (FIG. 7A-7E). Cloning into full-length antibody expression constructs was performed en masse, that is, to perform all molecular steps on full libraries rather than individual clones. Briefly, the protocol involved a series of two Gibson assemblies, which are referred to as Gibson assembly 1 (GA1) and Gibson assembly 2 (GA2) (FIGS. 12A and 12B). In GA1, the scFv library was inserted into a vector backbone that contained a promoter, a fragment of the IgG1 constant domain and a poly(A) signal. In GA2, the GA1 plasmid was linearized, and subcloned it into a DNA fragment that contained a fragment of the IgK constant domain, a second poly(A) signal and a second promoter.

Production cell lines for monoclonal antibodies are typically produced by randomly inserting expression constructs into the CHO genome. This method produces cell lines with genomic insertion of multiple copies of the expression construct. If polyclonal antibody construct libraries are inserted randomly into the CHO genome, because each cell might contain several inserted transgenes, many clones would express multiple antibodies, which would result in frequent nonnative pairing between heavy and light chain immunoglobulin. Additionally, different genome locations have different transcriptional activity levels, which could result in heterogeneous, inconsistent and/or unstable bioproduction. Applicant therefore used CHO cell lines engineered with a Flp recombinase recognition target landing pad (FIG.

13E). These cell lines were then used for stable expression of recombinant hyperimmune globulins or RPPs in polyclonal cell banks.

Recombinant Hyperimmune Globulins or RPPs for SARS-CoV-2

To address the urgent unmet clinical need of the COVID-19 pandemic, methods provided herein were to build recombinant hyperimmune globulins against SARS-CoV-2, which is referred to as recombinant coronavirus-2 immune globulin, or rCIG. In March 2020, 50 human donors were recruited from a single clinic in Louisiana who either had tested positive for SARS-CoV-2 by nasal swab PCR testing or had shown symptoms of COVID-19 around the time of a major local outbreak. First, anti-SARS-CoV-2 plasma titer was assessed for each of the donors using the S1 and receptor binding domain (RBD) regions of SARS-CoV-2 spike glycoprotein (FIG. 8A and Table 6). A wide range of half-maximum effective concentration ($EC_{50}$) values was observed among patients who tested positive for COVID-19 (range 0.0056-9.94 mg ml$^{-1}$). 16 donors with high plasma antibody titers was selected and used to build yeast scFv display libraries from pools of two donors, for a total of eight libraries. The libraries comprised a median of 70,940 antibodies (range 54,986-156,592, Table 7).

Applicant used flow sorting to enrich for anti-SARS-CoV-2 antibodies in the eight yeast scFv libraries (FIG. 8B, FIG. 14A-14B and Table 7). One round of flow sorting suggested that a median of 0.99% of antibodies (range 0.42-2.29%) were directed against SARS-CoV-2. After two rounds of sorting, a median of 62.7% of unsorted antibody sequences were human IgG1 subtype (range 51.5-83.4%), whereas in the sorted libraries a median of 82.4% of antibody sequences were human IgG1 subtype (range 63.6-92.2%), suggesting that the COVID-19 antibody response was generally dominated by IgG1 antibodies. Next, full-length polyclonal antibody preparations were generated from each of the eight scFv libraries. The antibodies were formatted as human IgG1, regardless of the initial IgG subtype. Anti-SARS-CoV-2 enzyme-linked immunosorbent assay (ELISA), spike:ACE2 blocking assays and pseudotype and live virus neutralization assays were used to assess the relative activity of each of the eight antibody libraries (FIG. 8F, FIGS. 15 and 17A-17C and Table 7). The eight scFv-sorted CHO cell banks were used in a way that sought to balance high antibody diversity with high anti-SARS-CoV-2 pseudotype neutralization titer (Table 8) and used the combined cell bank to generate rCIG protein product (FIG. 18A-18B). In preparation for manufacturing rCIG for clinical trials, a comprehensive polishing strategy was developed. Stress testing showed that the polished protein quality and function was highly stable, suggesting that rCIG was amenable to large-scale manufacturing (FIG. 19A-19D). This entire process, from delivery of the first donor sample to laboratory-scale generation of the rCIG protein product, was completed in less than 3 months.

Antibody RNA sequencing of the final CHO cell bank indicated that the rCIG drug candidate comprised a diverse set of 12,500 antibodies (FIG. 8C and Table 9). Additional repertoire analysis of the linked scFv and CHO cell bank libraries for rCIG was performed, including variable gene usage frequency, divergence from germline, CDR3H length distribution and sequence logos of the most abundant clonal clusters (FIG. 20A-20D, FIG. 21A-21C). Anti-SARS-CoV-2 ELISA suggested that the binding titer of rCIG was between 99- and 747-fold higher than corresponding plasma (FIG. 8D, FIG. 15 and Table 7 and 9). ELISAs with several natural variants of SARS-CoV-2 and antigens from related viruses, including SARS-CoV and Middle East respiratory syndrome (MERS) CoV, showed that rCIG bound a broader variety of antigen targets than IVIG or a neutralizing CoV-2 monoclonal antibody (mAb; FIG. 8E, FIG. 22 and Table 9). SARS-CoV-2 pseudotype virus neutralization assay was performed with psudotype virus of several SARS-CoV-2 variants (B.1.1.7 (UK), B.1.351 (South Africa), P.1 (Japanese/Brazilian), and B.1.427/B.1.429 (California)). The result showed that rCIG neutralizes the psudotype virus of the variants in a concentration dependent matter, with an $IC_{50}$ within 6-fold of the $IC_{50}$ determined using the Wuhan-Hu-1 psudoviral particle (FIG.51 and FIG. 52). The rCIG RPP therefore has broad activity across variants against which individual monoclonal antibodies are not active.

Finally, spike:ACE2 blocking assays, pseudotype virus neutralization assays and live SARS-CoV-2 neutralization assays suggested that the neutralizing titer of rCIG was between 44- and 1,767-fold higher than corresponding convalescent plasma (FIG. 8F, FIGS. 16A and 16B, and Tables 7 and 9).

Figure 23A:
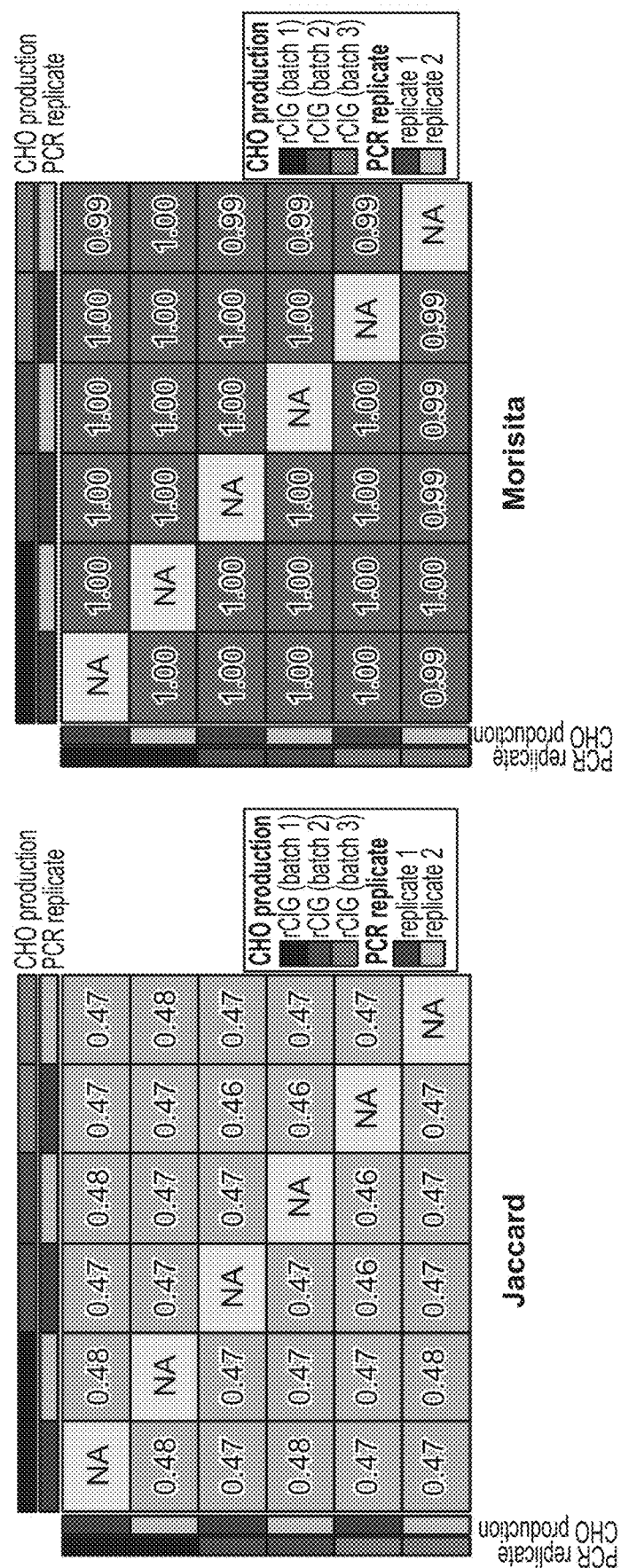
Figures 23B, 23C:
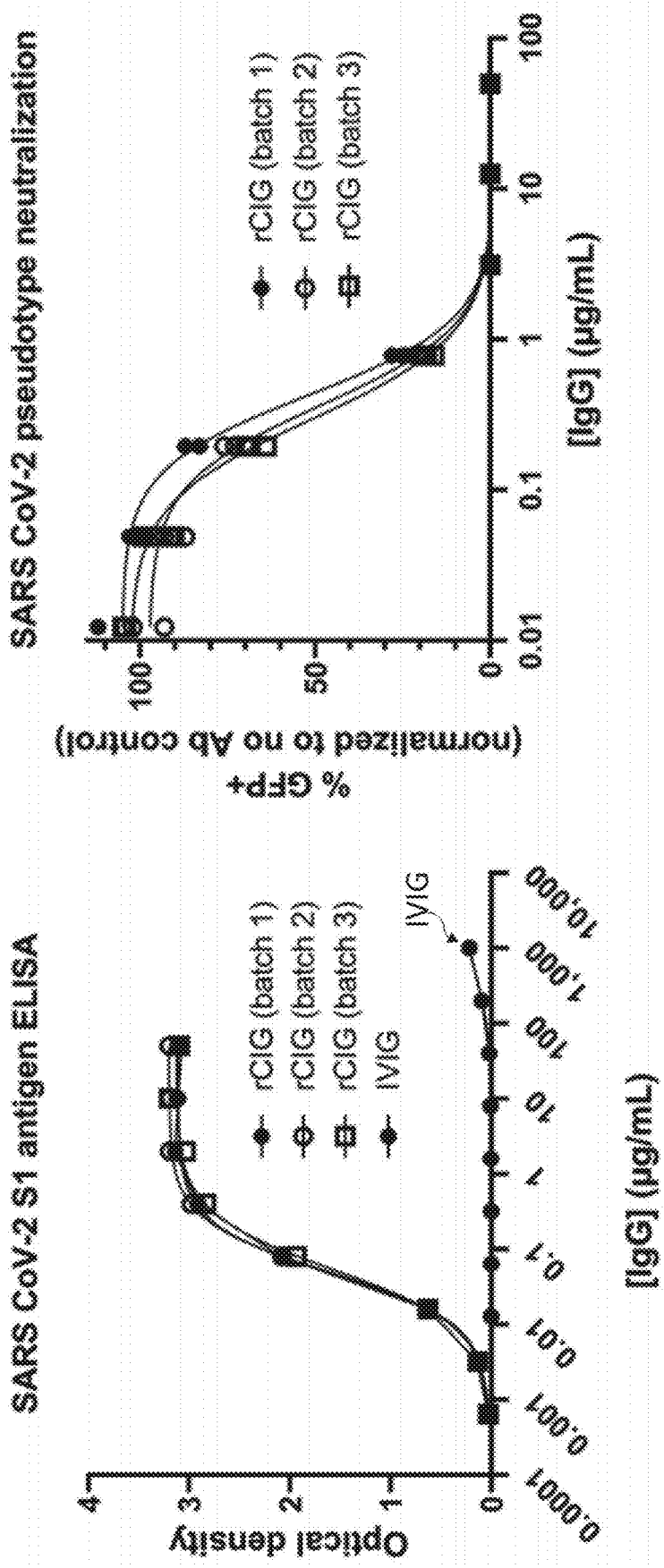

Antibody RNA sequencing of the CHO cells and SARS-CoV-2 ELISA binding and SARS-CoV-2 pseudotype neutralization of rCIG protein generated from replicate 3-1 bioreactor runs did not show significant batch-to-batch variation in antibody sequence content (Wilcoxon rank sum test, P>0.05) or in vitro pseudotype neutralization (Feltz and Miller's asymptotic test, P>0.05; FIGS. 23A and 23B).

Recombinant Hyperimmune Globulin or RPP for Zika Virus

Figure 24A:
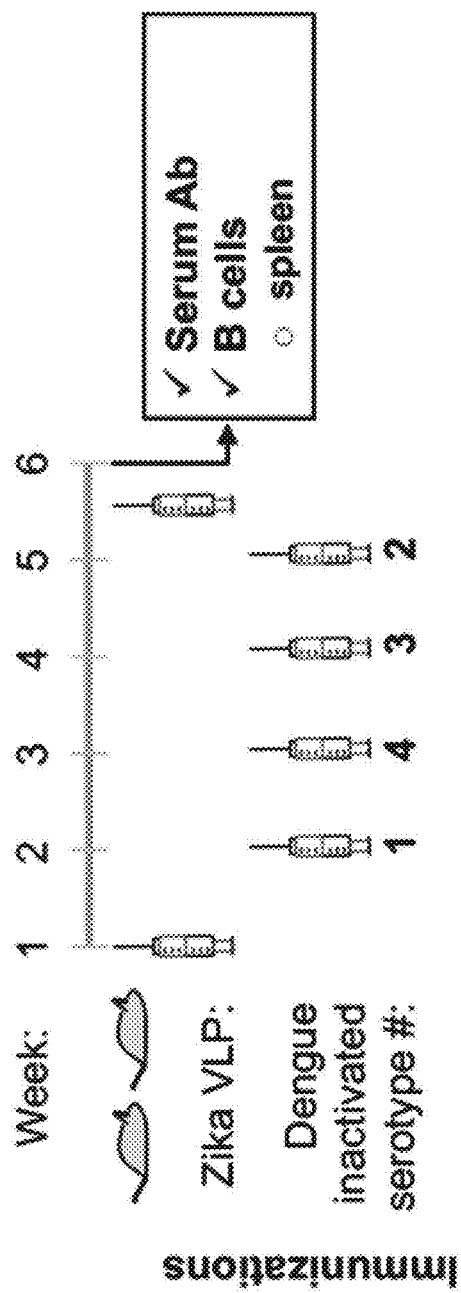
Figure 24B:
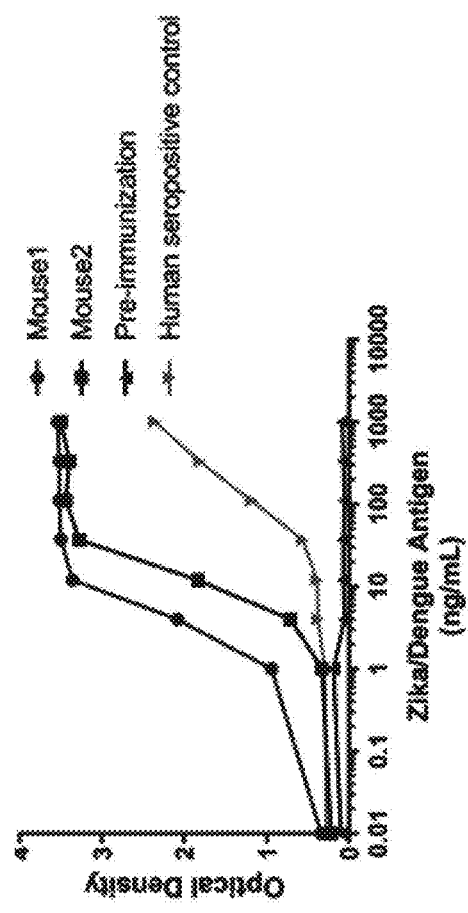
Figure 25A:
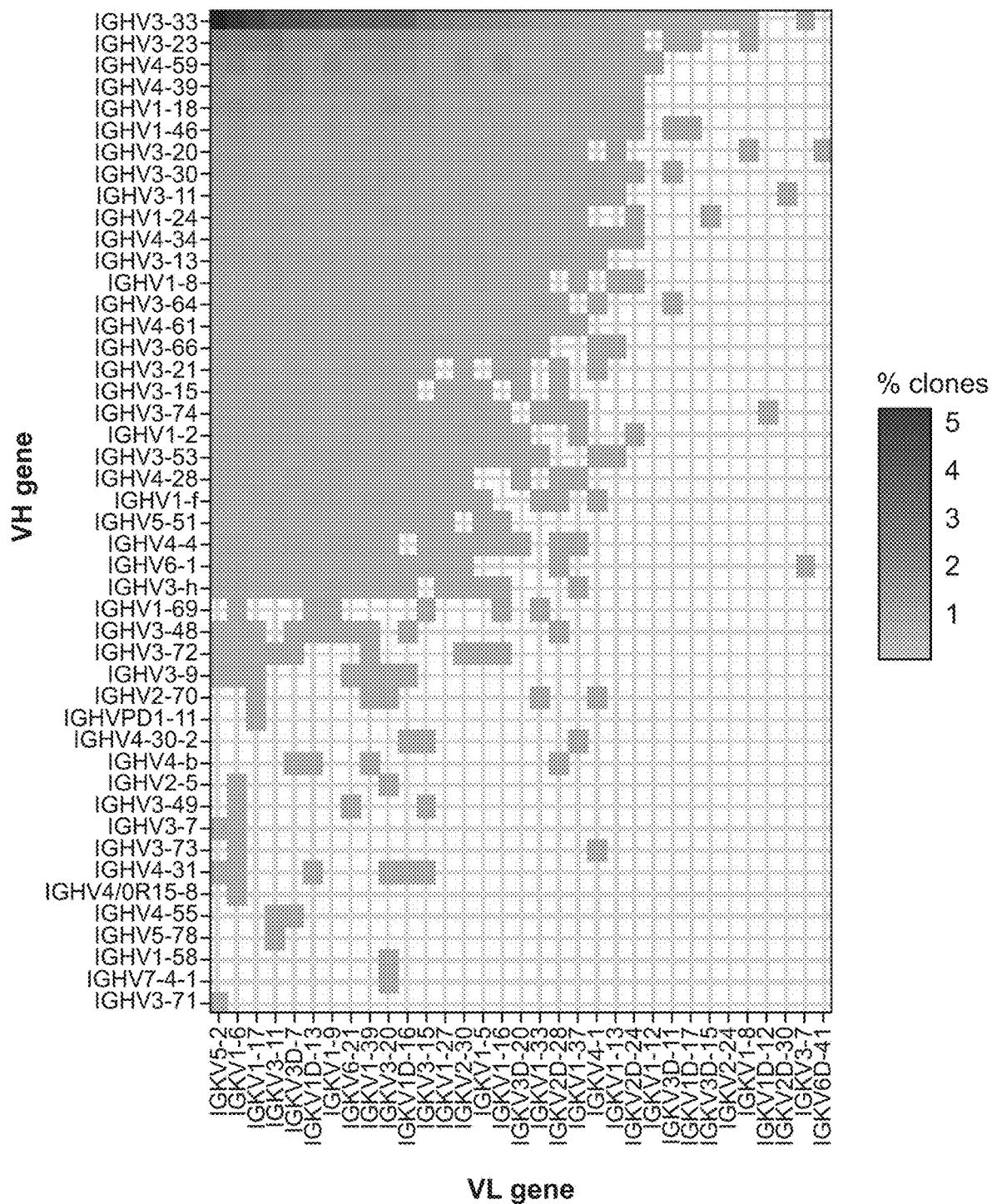
Figure 25B:
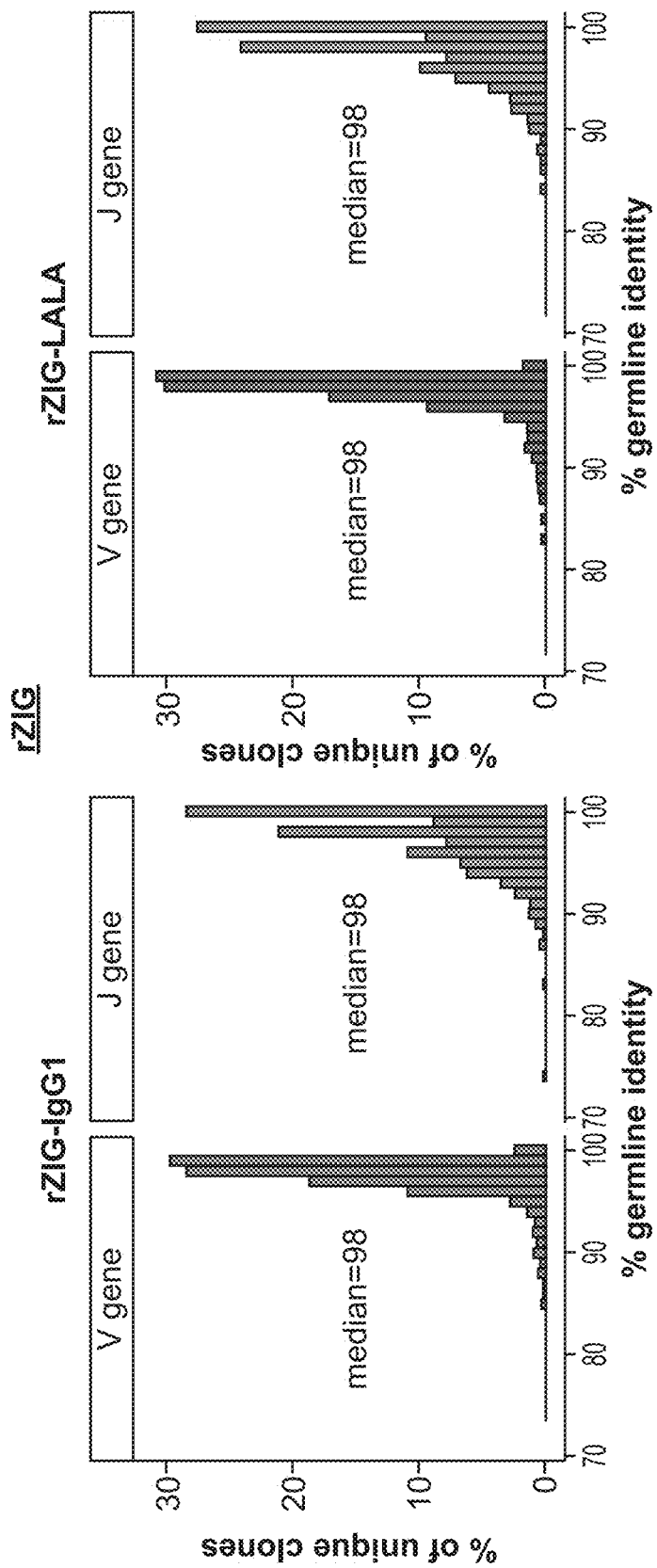
Figure 25C:
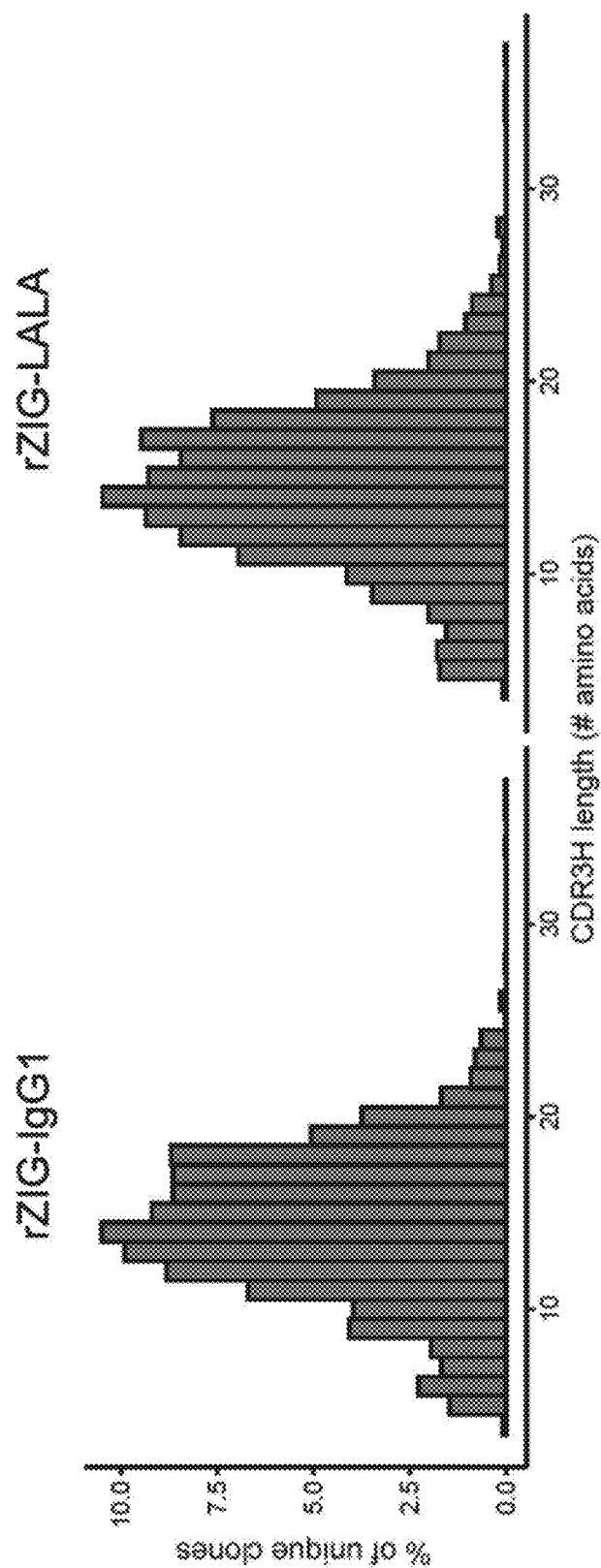
Figure 25D:
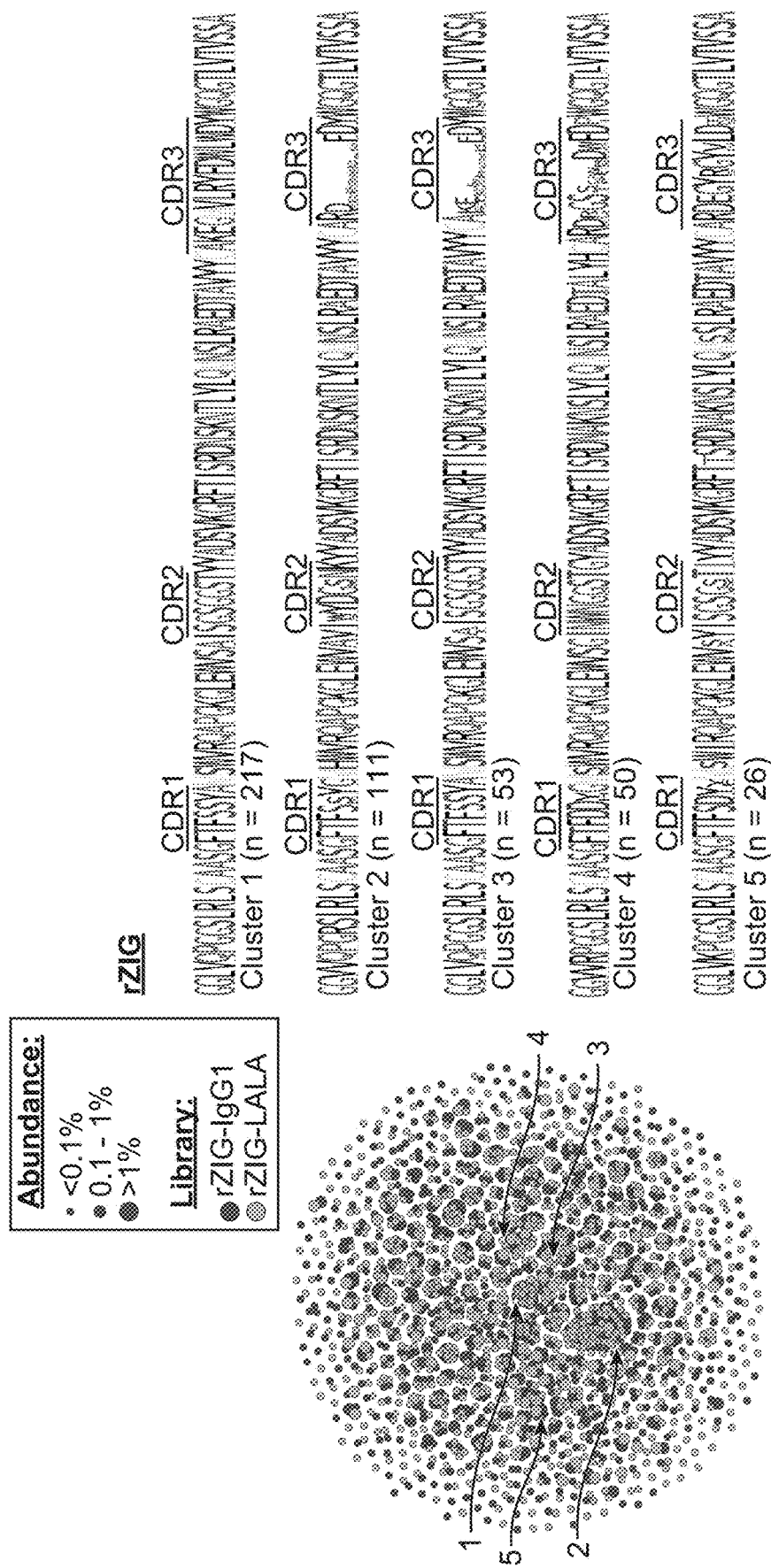
Figures 26A, 26B:
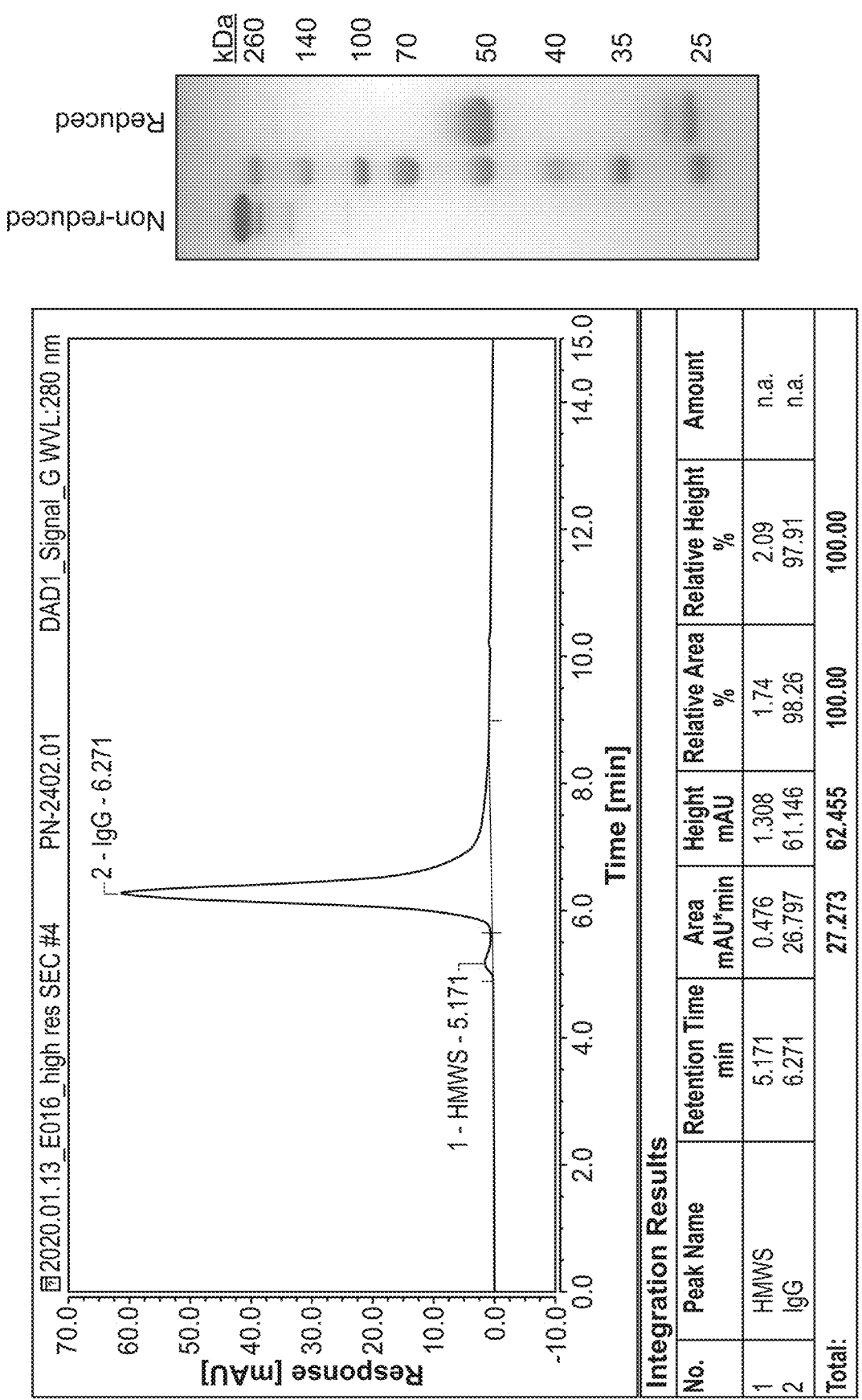
Figure 27B:
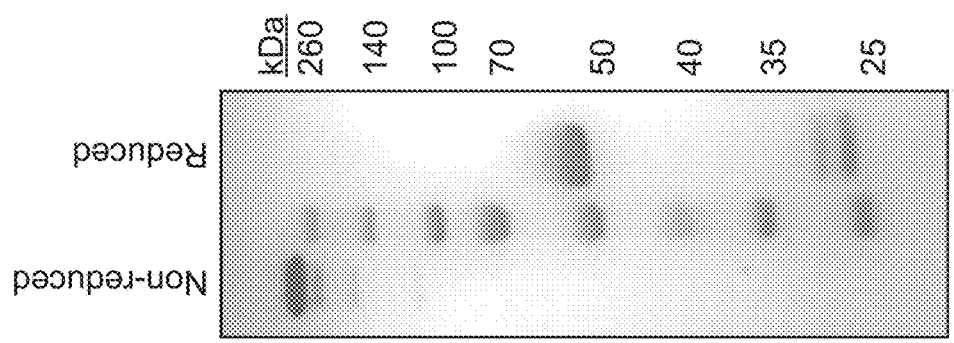
Figure 27A:
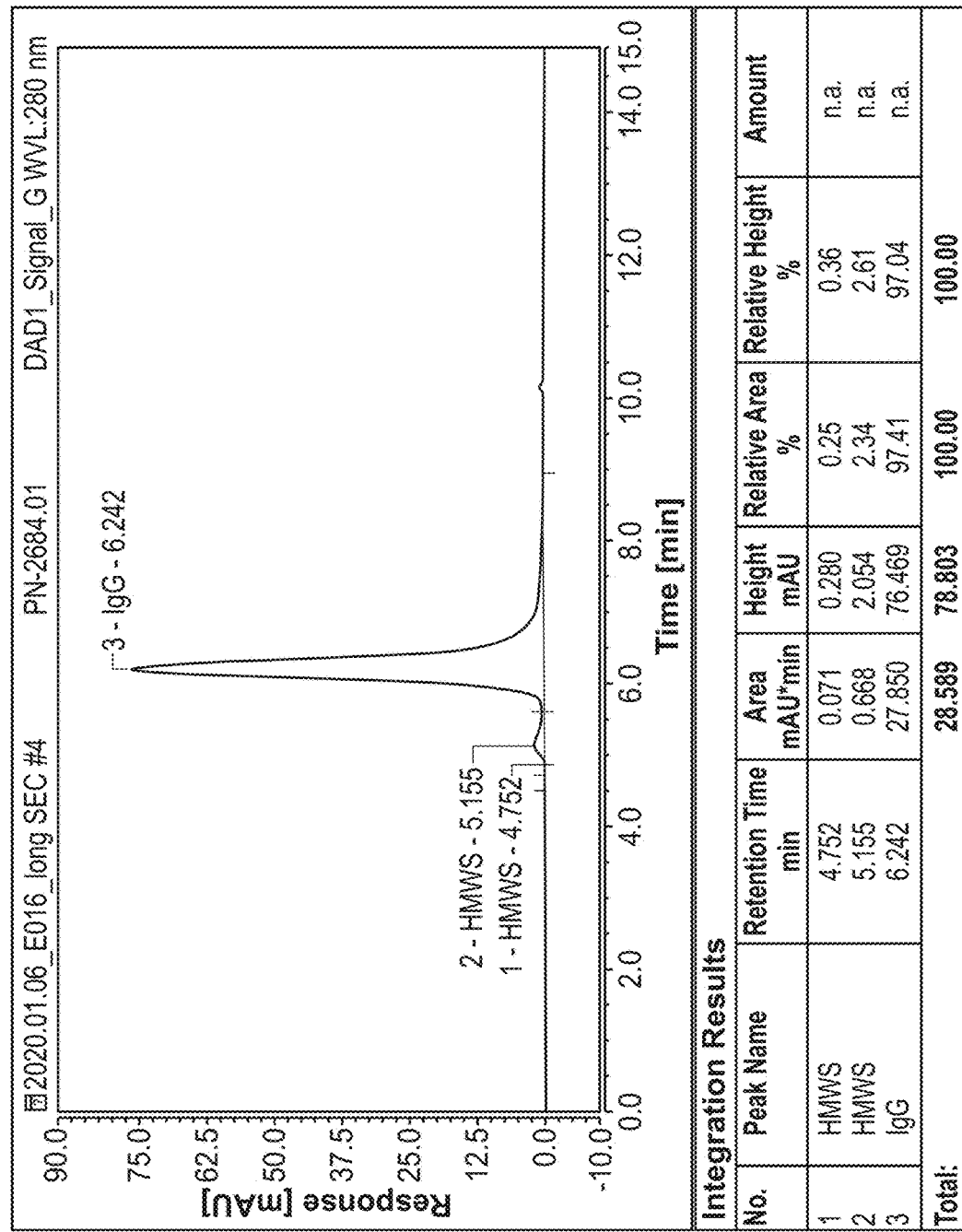

To address the Zika pandemic, the method described herein was to build recombinant hyperimmune globulins or RPP against Zika virus, which is referred to as recombinant Zika immune globulin, or rZIG. To create rZIG RPP, human-transgenic mice (Trianni) was used that expressed a complete repertoire of human antibody sequences. The mice were immunized with Zika virus antigens (FIGS. 24A and 24B). To explore the ability to engineer an rZIG that would not exhibit antibody-dependent enhancement (ADE), a safety concern for anti-Zika therapeutic antibodies, Applicant additionally boosted with four inactivated dengue virus serotypes.

B cells from the immunized animals and microfluidics technology were used to create an scFv library of natively paired IgGs. The resulting scFv library comprised approximately 119,700 IgG-IgK clonotypes (Table 10). Because enrichment by flow sorting is time-consuming and makes (possibly inappropriate) choices about viral epitope targets, the potency of an rZIG product produced without enrichment by flow sorting was assessed. To this end, the unsorted scFv library and CHO engineering technology to create rZIG CHO cell banks with a wild type human IgG1 isotype (rZIG-IgG1) or a mutated human IgG1 with abrogated Fc receptor (FcR) binding (rZIG-LALA) were used. Antibody RNA sequencing of IgG sequences in the rZIG cell banks suggested that the rZIG-IgG1 comprised 33,642 antibodies and rZIG-LALA comprised 26,708 antibodies (FIG. 9A and Table 11). A Morisita overlap of 86% and a Jaccard overlap of 58% between the rZIG-IgG1 and rZIG-LALA libraries suggested that the cell banks comprised substantially similar antibody repertoires. Additional repertoire analysis of the linked scFv and CHO cell bank libraries for rZIG was performed, including variable gene usage frequency, divergence from germline, CDR3 length distribution and sequence logos of the most abundant clonal clusters (FIG. 25A-25D). Applicant used these CHO cell banks to produce rZIG-IgG1 and rZIG-LALA hyperimmune globulins at laboratory scale (FIG. 26A-26B, FIG. 27A-27B).

Figure 28:
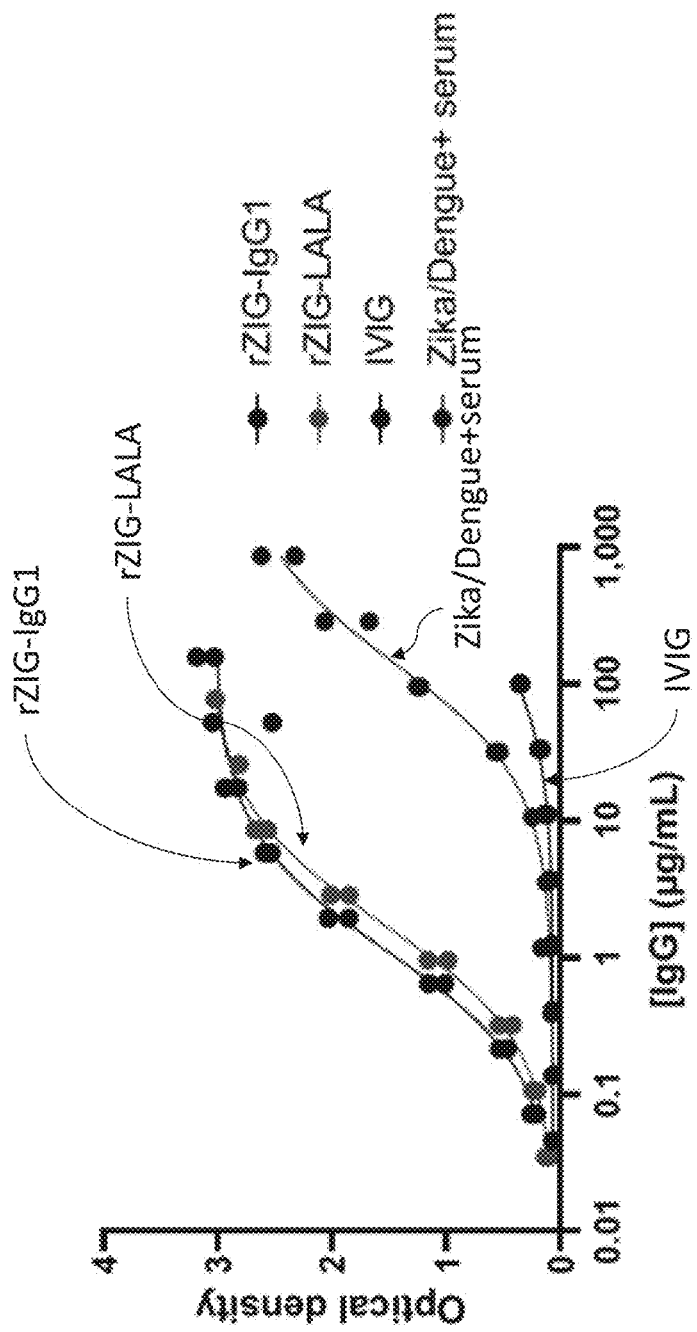
Figure 29:
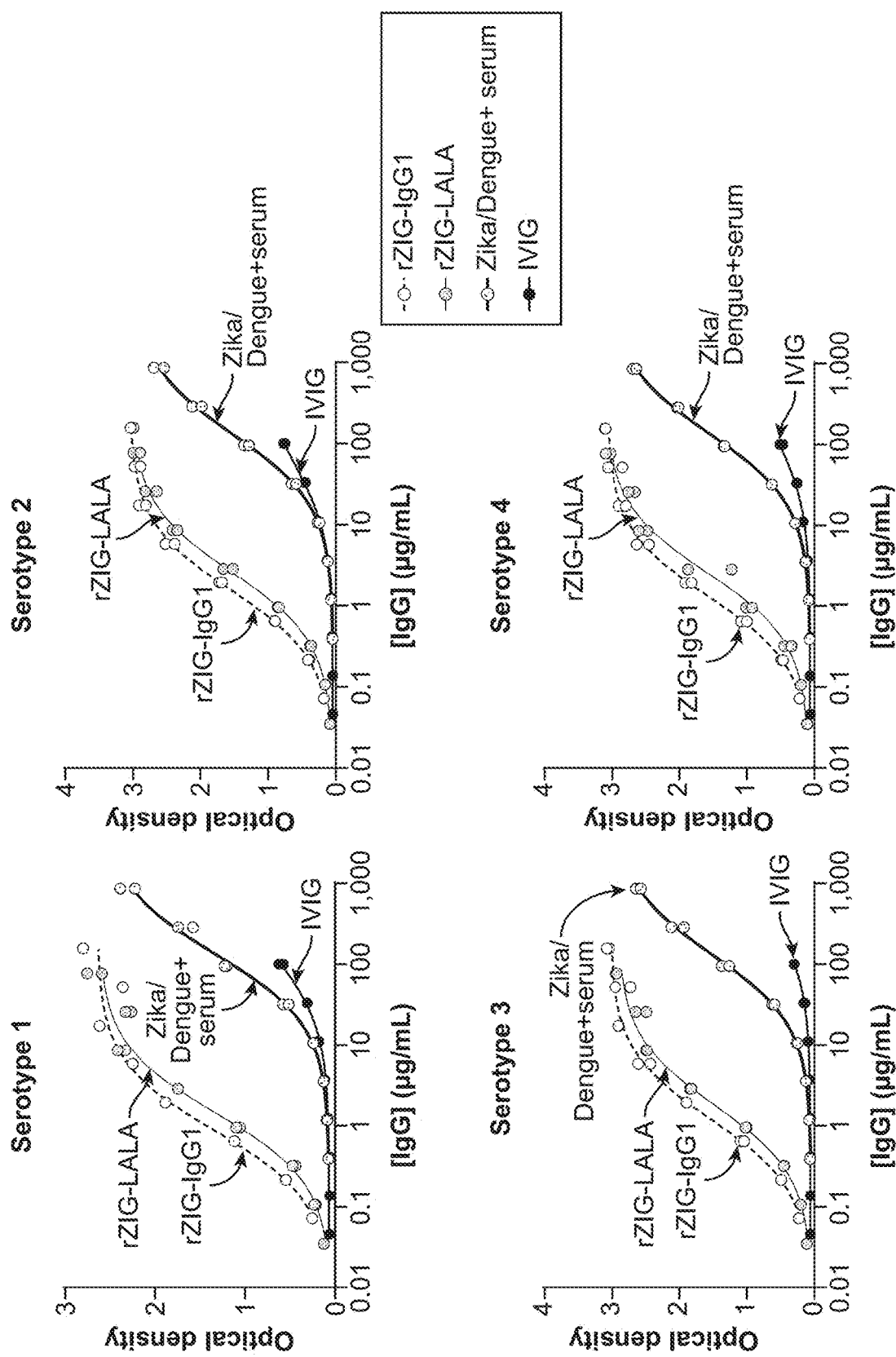

Anti-Zika virus ELISA showed that both rZIG-LALA and rZIG-IgG1 had >75-fold higher titers against Zika virus than a human Zika positive serum sample (FIG. 28 and Table 11). Both rZIG-LALA and rZIG-IgG1 had anti-dengue binding activity across four serotypes, with pooled $EC_{50}$ values showing strong correlation with anti-Zika $EC_{50}$ values (linear regression, $R^2$=0.9993, F-statistic P<0.001; FIG. 9B, FIG. 29 and Table 10). In contrast, although both rZIG-LALA and rZIG-IgG1 had strong activity in a Zika pseudotype neutralization assay (FIG. 30), there was no correlation between Zika and pooled dengue neutralization (linear regression, $R^2$=0.00271, F-statistic P>0.05; FIG. 9C and FIG. 31). Applicant investigated whether the abrogated Fc function of rZIG-LALA could decrease ADE in a Zika pseudotype virus assay (FIG. 32). Both Zika$^+$ human serum and rZIG-IgG1 showed considerable ADE, whereas rZIG-LALA showed no detectable ADE (FIG. 9D). Antibody RNA sequencing of the CHO cells and anti-Zika virus ELISA binding of rZIG-IgG1 and rZIG-LALA protein generated from replicate bioproduction runs did not show significant batch-to-batch variation in antibody sequence content (Wilcoxon rank sum test, P>0.05), and batch-to-batch anti-Zika virus ELISA results were indistinguishable (FIG. 33A-33B).

IVIG Spike-In for Patients with Primary Immunodeficiencies

Plasma-derived IVIG acts as antibody replacement for patients with humoral primary immunodeficiencies ("PID"), who have low serum IgG titers. However, it has insufficient antipathogen activity for certain patients at-risk for PID. To address this unmet clinical need, Applicant manufactured recombinant hyperimmune globulins or RPPs directed against pneumococcus and Hib bacteria, designed as multivalent 'spike-ins' for plasma-derived IVIG, that is, recombinant *Haemophilus* immune globulin (rHIG) and recombinant pneumococcus immune globulin (rPIG). Note that rHIG and rPIG are not replacements for IVIG, but rather supplements meant to increase the efficacy of IVIG. A full recombinant replacement for IVIG would require much broader antipathogen activity.

Healthy human donors were recruited and administered vaccines directed against pneumococcus or Hib. Eight to nine days after vaccination, peripheral blood mononuclear cells (PBMCs) were collected and shipped to our microfluidics processing facility. B cells from the PBMCs were selected and millions of cells were run through the microfluidics platform (Table 12), and then the scFv libraries and the CHO engineering technology were used to create IgG1 CHO cell banks for rHIG and rPIG. Heavy chain antibody RNA sequencing of the cell banks indicated that rHIG comprised 49,206 IgG sequences and rPIG comprised 17,938 IgG sequences (FIG. 10A and Table 13 and 14). Additional repertoire analysis of the linked scFv and CHO cell bank libraries for rHIG and rPIG was performed, including variable gene usage frequency, divergence from germline, CDR3 length distribution and sequence logos of the most abundant clonal clusters (FIGS. 34A-34D and 35A-35D). These CHO cell banks were used to produce rHIG and rPIG hyperimmune globulins at laboratory scale (FIGS. 36A-36B and 37A-37B).

Anti-Hib ELISA indicated that rHIG had 233-fold higher titer than plasma-derived IVIG (FIG. 10B and Table 13). A serum bactericidal assay demonstrated that rHIG was strongly active against two different Hib strains, whereas no bactericidal activity was observed for plasma-derived IVIG (FIG. 10C, FIG. 38 and Table 13). An ELISA against a combination of 23 pneumococcus serotypes showed that rPIG has 85-fold higher titer than plasma-derived IVIG (FIG. 39 and Table 14). ELISA for individual pneumococcus serotypes showed that rPIG was at least fivefold higher titer than plasma-derived IVIG for 13 out of 16 serotypes measured, indicating broadly enriched multivalent reactivity and significantly higher than IVIG overall across all separate ELISAs combined (Wilcoxon signed rank test, P=0.00123; FIG. 10D and Table 14). Finally, semiquantitative serotype-specific opsonophagocytosis assays suggested that rPIG was as effective or more effective than plasma-derived IVIG at cell killing for 15 out of 16 serotypes tested, and had significantly higher activity than IVIG across all separate opsonophagocytosis assays combined (Wilcoxon signed rank test, P=0.00251; FIG. 10D and Table 14). Antibody RNA sequencing of the CHO cells and anti-Hib or antipneumococcal ELISA binding of rHIG or rPIG protein generated from replicate bioproduction runs, respectively, did not show significant batch-to-batch variation in antibody sequence content (Wilcoxon rank sum test, P>0.05), and batch-to-batch antipathogen ELISA results were indistinguishable (FIGS. 40A-40B and 41A-41B).

To simulate the potential clinical application, rHIG and rPIG were mixed in with plasma-derived IVIG (IVIG+rHIG/rPIG) at a ratio of 1:1:8 (rHIG:rPIG:IVIG), producing a product with 18.3-fold higher titer than plasma IVIG for Hib and 8.3-fold higher titer than plasma IVIG for a pool of 23 pneumococcus serotypes (FIG. 42A-42B and Table 15). A Hib mouse challenge model using IVIG+rHIG/rPIG as prophylactic treatment showed significantly lower bacterial loads in the blood (Welch t-test, P<0.001) and peritoneal fluid (Welch t-test, P<0.001) as compared to plasma IVIG alone (FIG. 10E).

Recombinant Human ATG RPP for Transplant Tolerance

To encourage tolerance of grafts, transplant physicians use a variety immunosuppressive drugs, such as rabbit-ATG, which is manufactured by injecting rabbits with human thymocytes and isolating antibodies from the rabbit serum. However, rabbit-ATG can cause allergic reactions and other complications in humans, and the drug shows significant variation in potency across lots. To improve on rabbit-ATG, a recombinant human ATG, or rhATG RPP, derived from transgenic mice that express human antibodies (Trianni) were used. The mice were immunized with either human T cells or human fetal thymocytes (FIG. 43A-43B). B cells from the immunized animals and the microfluidics technology were used to create four scFv libraries of natively paired IgGs: bone marrow cells from T-cell immunized mice, lymph node cells from T-cell immunized mice, lymph node cells from thymocyte immunized mice and spleen cells from thymocyte immunized mice. The resulting scFv libraries comprised a range of 13,314 to 34,324 IgG-IgK clonotypes (Table 16). Additional repertoire analysis of the linked scFv and CHO cell bank libraries for rhATG was performed, including variable gene usage frequency, divergence from germline, CDR3 length distribution and sequence logos of the most abundant clonal clusters (FIG. 44A-44D). The CHO engineering technology was used to make cell banks from each of the four libraries.

Protein from each of the CHO cell banks was produced, and then pooled in equal mass equivalents to create rhATG (FIG. 45A-45B). Sequencing of individual libraries suggests that the pool comprised 49,885 antibodies (FIG. 11A and Table 17). Then ELISA was performed for a panel of known cell surface antigen targets for rabbit-ATG, and observed that rhATG bound several immune cell surface targets, but only a subset of the targets bound by rabbit-ATG (FIG. 46A-46B). To investigate further, in vitro cell killing assays were performed with human PBMCs, which showed that rhATG and rabbit-ATG were not significantly different in cell killing potency against cytotoxic T cells and helper T cells (linear mixed effects model, P>0.05), whereas rhATG is significantly stronger than rabbit-ATG at killing B cells (linear mixed effects model, P<0.01) but significantly weaker than rabbit-ATG at killing natural killer cells (linear mixed effects model, P<0.01; FIG. 11B). Anti-erythrocyte binding assays were also performed, which suggested that rhATG has less off-target activity than rabbit-ATG (FIG. 47).

The efficacy of rhATG in vivo was also studied, using a graft-versus-host (GVH) model in which human PBMCs were grafted onto immune-incompetent mice. Animals (n=8 per PBMC donor) were dosed with rhATG, rabbit-ATG or vehicle control, either every other day for 5 weeks starting 5 days after the PBMC graft, or only on days 5, 6 and 7 after the graft. Two different PBMC donors were tested for each dosing regimen. After 42 days, rhATG was not significantly different from rabbit-ATG for survival (log-rank pairwise tests, P>0.05) and was superior to vehicle control for survival (log-rank pairwise tests, P<0.001), in both dosing schemes across multiple PBMC donors (FIG. 11C and FIG. 48A-48B). In both dosing regimens across both PBMC donors, immune cell (CD45$^+$) expansion was not significantly different between rhATG and rabbit-ATG (linear mixed effects model, P>0.05), whereas for the vehicle control immune cell counts were significantly higher than rhATG at day 9 (Wilcoxon rank sum tests, P<0.01; FIG. 11D and FIG. 49A-49B). The conclusion was that although rhATG and rabbit-ATG did not share identical antigen targets, the drugs had similar efficacy in vivo.

Discussion

Applicant demonstrated the generation of multivalent, $10^3$ to $10^4$ diverse recombinant hyperimmune antibody drugs (RPPs) from convalescent human blood donors, vaccinated human blood donors and humanized mouse repertoires. The drug candidates were validated using in vitro and in vivo methods, highlighting their advantages over plasma-derived incumbents. The technology combines methods in microfluidics, genomics and mammalian cell engineering. Contrasted against previous methods for generating recombinant polyclonal antibodies, our drug candidates had hundreds-fold higher antibody diversity and therefore represented higher fractions of antigen-reactive repertoires. Their advantages over plasma-derived products include higher potency, the ability to scale production without collecting further donors, consistency of production and the ability to modulate pharmacologic problems such as ADE. The technology is fast, producing a master cell bank against a poorly characterized virus (SARS-CoV-2) in less than 3 months. The rCIG product (GIGA-2050) has now been manufactured at a good manufacturing practice (GMP) facility. GMP production was similar to the methods described in this study, except that upstream bioproduction was performed in a single use bioreactor at the 250-liter scale and downstream purification was scaled equivalently.

Emerging viruses are a constant and unpredictable threat to human health. In the past two decades alone, the world has seen outbreaks of Ebola virus, SARS, MERS, 2009 H1N1 swine flu, Zika Virus and SARS-CoV-2, among others. Notwithstanding recent successes in rapid development of SARS-CoV-2 prophylactic vaccines, previous vaccine development efforts required very long development timelines. Development of broadly neutralizing monoclonal antibodies is often confounded by the difficulty of identifying broadly neutralizing epitopes, and escape variants can emerge over time. Because of such issues, convalescent COVID-19 plasma emerged as a promising approach early in the COVID-19 pandemic. However, convalescent plasma is difficult to manufacture at scale because convalescent plasma supply is constrained and each plasma donor supplies enough therapeutic for only 1-2 patients. The conclusion was that rCIG was a promising alternative to COVID-19 convalescent plasma due to significantly higher potency against live virus (Wilcoxon rank sum test, P=0.02869) and the ability to scale GMP production without the need to recruit more donors.

Although Zika virus has been less widespread and less deadly than SARS-CoV-2, Zika can spread from mother to fetus in utero, resulting in birth defects such as microcephaly. As of July 2020, there was no FDA-approved vaccine or therapy for Zika virus. Zika virus disease is complicated by ADE, a phenomenon in which poorly neutralizing antibodies enhance viral infection by bringing virus particles to cells that express FcR. This problem is particularly troublesome for individuals who have been previously infected with dengue, a related flavivirus, since many anti-dengue antibodies are poor neutralizers against Zika virus and vice versa. ADE is a safety concern in the development of plasma-derived hyperimmune globulins and vaccines. The conclusion was that rZIG-LALA was a promising alternative to plasma-derived drugs, due to high neutralizing potency against Zika virus and complete abrogation of the risk of ADE.

Although plasma-derived IVIG reduces rates of serious infections in PID, many patients still suffer frequent serious infections that require hospitalization. In particular, about 78% of serious lung infections are caused by pneumococcus and Hib bacteria. Clinicians have improved outcomes by further increasing IVIG doses, suggesting that, however, bacterial species are often incredibly diverse; for example, there are 90 known pneumococcus serotypes, complicating therapeutic development. The conclusion was that a polyvalent IVIG+rHIG/rPIG product had strong potential to address unmet clinical needs in patients with PID through increased potency against key pathogens.

In 2019, nearly 40,000 solid organ transplants were performed in the USA alone (unos.org). Transplantation generally introduces at least some mismatch between the human leukocyte antigen genotypes of the donor and host. This frequently results in some host-versus-graft effects, leading to loss of the graft and other serious complications. The work provided herein suggested that rhATG could one day address unmet clinical needs in transplant tolerance.

Our technology for generating recombinant hyperimmune globulins combines the advantages of recombinant antibodies (purity, consistency, potency) with the advantages of plasma-derived antibodies (proven efficacy, diversity, polyvalence, in vivo affinity maturation). The study disclosed herein has shown how the technology can improve existing plasma-derived products such as IVIG and rabbit-ATG. Polyclonal antibodies contain drugs with different mechanisms of action, potentially increasing efficacy; for example, rCIG may contain some antibodies optimized to block binding of virus to ACE2 and other antibodies optimized to clear virus through complement fixation. In the future, our technology could be used to develop drugs with new mechanisms of action, for example, antitumor antibody mixtures or antiplasma cell mixtures to cure humoral-driven autoimmune disease. It could also be extended to develop recombinant polyclonal IgM or IgA. To strengthen readiness against future pandemics, recombinant hyperimmune globulin cell banks against the most pressing biodefense threats could be produced preemptively.

Methods

Generating Paired Heavy and Light Chain Libraries

Generation of scFv libraries from antibody-producing cells comprises three steps: (1) poly(A)+mRNA capture, (2) multiplexed OE-RT-PCR) and (3) nested PCR. Briefly, a microfluidic device captures single cells in droplets with a mixture of lysis buffer and oligo dT beads (NEB). After the cell is lysed and messenger RNA is bound to the bead, the emulsion is broken and the mRNA-containing beads are purified. Next, an emulsion is created using OE-RT-PCR reagents including a pool of primers directed against the IgK C region, the IgG C region and all V regions (Table 18), and the mRNA-bound beads as a template. The emulsion is subjected to thermal cycling, which creates complementary DNA, amplifies the IgK and IgG variable regions and links them together in an scFv format. Then the emulsion is broken and the linked scFv DNA product is extracted and purified. The purified scFv product is then amplified using nested PCR to remove artifacts and add adapter sequences. Depending on the adapter sequences, the product can be used for deep sequencing, yeast display libraries or full-length CHO expression.

To convert the scFv libraries into full-length CHO expression libraries, nested outer PCR primers were first used to add adapters with overhangs for Gibson assembly to the 5' and 3' ends of the scFv library (for rCIG, this was done after yeast scFv display enrichment, as described in the next section). Then NEBuilder HiFi DNA Assembly Master Mix (NEB) was used to insert the scFv library into a vector containing a single promoter, a secretory leader sequence for light chain immunoglobulin and the remainder of the IgG1 constant region, creating a cloned scFv library (GA1 backbone, FIG. 12A-12E; GenBank accession number MW079271). This intermediate library (GA1 product, FIG. 12A-12E; example plasmid sequence provided as GenBank accession number MW079272) was transformed into *E. coli* and plasmids were purified by either (1) spreading onto LB-ampicillin plates, scraping 0.5-1 million colonies and pooling or (2) inoculating directly into LB-ampicillin broth and growing overnight. Plasmid purification was performed using ZymoPURE II Plasmid Maxiprep Kits (Zymo Research). To create the full-length antibody library, a second Gibson assembly was performed by linearizing the GA1 product with BamHI-HF (rHIG) or NheI-HF (rCIG, rPIG, rhATG and rZIG) (NEB) and using it as a vector to insert a synthetic amplicon (Supplementary FIG. 2, GenBank accession number MW079275) containing a portion of the light chain immunoglobulin constant region, a poly(A) signal for light chain immunoglobulin, a promoter for the IgG gene and a secretory leader sequence for the IgG gene. The full-length library was then transformed into *E. coli* and spread on LB-ampicillin plates. >0.5 million colonies were combined and plasmid was purified with a ZymoPURE II Plasmid Maxiprep Kits (Zymo Research) to make the full-length recombinant hyperimmune globulin maxiprep library for transfection (GA2 product, FIG. 13A-13E; example plasmid sequence provided as GenBank accession number MW079273). When the transformed *E. coli* were inoculated directly into LB-ampicillin medium, a small volume of cells was plated to calculate the total number of transformants. In some cases, ampicillin was used for both plates and medium, whereas in other cases carbenicillin was used instead of ampicillin. Paired heavy and light chain libraries were made only once from each sample.

Enrichment for Antigen Binders By Yeast scFv Display

Polyclonal COVID-19 scFv libraries were sorted to enrich for relevant sequences. Briefly, yeast surface display scFv libraries were generated using COVID-19 scFv DNA libraries and a custom yeast surface display vector transformed by electroporation into EBY100 yeast strain (MYA-4941, ATCC). Surface displayed scFv sequences include a C-terminal myc tag to identify scFv expression with 1 µl per sample of undiluted anti-myc primary (A21281, Thermo Fisher Scientific) and 1 µl per sample of undiluted AF488 secondary antibody (A11039; Thermo Fisher Scientific). Binding to antigen was identified by staining with soluble biotinylated SARS-CoV-2 RBD antigen (SPD-C82E9, Acro Biosystems) at 1,200 nM and APC-streptavidin (SA1005, Thermo Fisher Scientific). Stained yeast libraries were sorted on a FACSMelody (BD Biosciences, with BD fluorescent activated cell sorting (FACS) Chorus software v.1.3.3) and double positive (AF488$^+$/APC$^+$) cells were collected. The gating strategy is outlined in FIG. 14A-14B. The collected cells were expanded and sorted again to further enrich the libraries. After the second round of sorting, cells were expanded a third time before plasmid isolation with a Zymoprep Yeast Plasmid Miniprep kit (Zymo Research). The plasmid libraries were then used as template for barcoding PCR and subsequent analysis by deep sequencing (Illumina). Plasmid from twice-sorted libraries was used as template for PCR toward full-length CHO antibody expression. Yeast scFv sorting was performed only once from each yeast scFv library.

Bioproduction of rHIG and rhATG

Adapted Flp-In-CHO cells stably expressing antibody libraries were grown in media consisting of 90% BalanCD CHO Growth A Medium (Irvine Scientific), 9% Ham's F-12 (Thermo Fisher Scientific), 1% FBS (Thermo Fisher Scientific), 4 mM Glutamax (Thermo Fisher Scientific), 0.2% anticlumping agent (Irvine Scientific), 600 µg ml$^{-1}$ Hygromycin-B (Gemini Bio). Protein production was performed at either small (250 ml) or medium (5 l) scale. For small-scale production, cells were seeded at 1×10$^6$ cells per ml into 50 ml of media in a 250 ml Erlenmeyer flask and grown at 37° C., 5% CO$_2$, 125 r.p.m. Cells were continually grown under these conditions and supplemented with 7.5 ml of CHO Feed 1 (Irvine Scientific) on days 2, 4 and 7 of the production run. Supernatant was harvested on days 8 or 9 by centrifugation followed by filtration through a 0.22-µm 250 ml filter bottle (MilliporeSigma) with a 1 µm prefilter (MilliporeSigma). Harvested cell culture fluid (HCCF) was stored at 4° C. (if less than 1 week) or at −80° C. (if more than 1 week) until Protein A purification. For medium-scale production, cells were grown in the same media. Cells were then seeded at 1×10$^6$ cells per ml in 2.3 l in a 5 l flask (in duplicate, day 0). Each flask was fed with 345 ml of CHO Feed 1 (Irvine Scientific) on days 2 and 4 of the culture. Cultures were gathered on days 8 or 9. Each of the four rhATG protein libraries were produced separately. Bioproduction was performed twice each for rHIG and rhATG.

Bioproduction of rPIG, rZIG and rCIG

CSS-1286 CHO cells stably expressing antibody libraries were grown in media without glutamine (EX-CELL CHOZN Advanced, MilliporeSigma). Protein production was performed at either small (500 ml flask) or medium (5 l flask) scale. For small-scale production, cells were seeded at 0.5×10$^6$ cells per ml into 100 ml media in a 500 ml Erlenmeyer flask and grown at 37° C., 5% CO$_2$, 125 r.p.m. Cells were continually grown under these conditions and supplemented with 15 ml of CHO Feed 1 (MilliporeSigma) on day 3, and 10 ml of CHO Feed 1 (MilliporeSigma) on days 6 and 8 of the production run. Starting on day 3, glucose was measured each day and supplemented to 6 g l$^{-1}$ if below 4 g l$^{-1}$. Supernatant was harvested after cell viability peak and before dropping below 70% viability between days 9 and 11, centrifuged and filtered through a 0.22-μm 250 ml filter bottle (MilliporeSigma) with a 1 μm prefilter (MilliporeSigma). HCCF was stored at 4° C. (if less than 1 week) or at −80° C. (if more than 1 week) until Protein A purification. For medium-scale production, cells were grown in the same media. Cells were seeded at 0.5×10$^6$ cells per ml in 2.2 L in a 5 L flask (in duplicate, day 0). Each flask was fed with 330 ml of CHO Feed 1 (MilliporeSigma) on day 3 and 220 ml of CHO Feed 1 (MilliporeSigma) on days 6 and 8 of the production run. Starting on day 3, glucose was measured each day and supplemented to 6 g L$^{-1}$ if below 4 g l$^{-1}$. Cultures were gathered on days 10-12. Bioproduction was performed three times for rCIG and twice each for rZIG and rPIG.

Protein Production and Characterization

After harvest, HCCF was purified using MabSelect PrismA (Cytiva) using 1×PBS (Teknova) for running and wash buffer, 0.1 M Citrate, pH 3.0 (Teknova) for elution and 1 M sodium citrate pH 6.0 (Teknova) for neutralization. The protocol was 10 column volumes (CV) of equilibration, HCCF loading, 10 CV of washing and 5-10 CV of elution followed by cleaning-in-place with 1 M NaOH. HCCF was loaded with a 1-min residence time. Eluted material was neutralized to a pH of roughly 4.5 and centrifuged to remove any precipitation. This material was dialyzed into 0.2 M glycine, pH 4.5 (Teknova) using a 20K molecular weight cutoff dialysis cassette (Thermo Fisher Scientific) and optionally concentrated up to 30 mg ml$^{-1}$ using a 50 kDa molecular weight cutoff spin device (MilliporeSigma). Final material was sterilized with a 0.22 μm filter and quantified by A280 (NanoDrop, Thermo Fisher Scientific). For rhATG, each of the four libraries were purified by Protein A separately and then equally pooled based on mass.

Purity of the protein was determined by size-exclusion-HPLC. Here, 20 μg of material at 1 mg ml$^{-1}$ was injected over a 300 Å, 2.7 μm, 7.8×300 mm size-exclusion column (Agilent) using a mobile phase of 25 mM phosphate, 200 mM NaCl pH 7.0 with 10% acetonitrile at 1 ml min$^{-1}$. The percentage of monomer was determined by integrating the product peaks and reporting the percent area corresponding to roughly 150 kDa. The product was further characterized by running 2 μg on a 12% SDS-PAGE gel under reduced and nonreduced buffering conditions and imaged after staining with SimplyBlue SafeStain (Thermo Fisher Scientific).

Protein production was performed once for each of the bioproduction runs.

Statistical Analysis

All statistical tests were performed on nonnormalized data, two-sided without adjustments to type I error rates. A significance threshold of $\alpha$=0.05 was used for all statistical tests. All statistical analyses were conducted using R v.3.6.2.

For FIG. 8F, a Wilcoxon rank sum test was used to compare the minimum concentration to achieve SARS-CoV-2 live virus neutralization between convalescent plasma measurements (n=16) and rCIG measurements (n=2).

For FIG. 9B, simple linear regression was used to calculate the coefficient of determination ($R^2$) between Zika and dengue ELISA EC$_{50}$ values. EC$_{50}$ values for all dengue serotypes were pooled for the analysis. Significance of the regression model was determined using an F-statistic with 1 and 10 degrees of freedom (d.f.). All measurements were performed in a single experiment. No power analysis was carried out to predetermine an appropriate sample size for this experiment.

For FIG. 9C, simple linear regression was used to calculate the coefficient of determination ($R^2$) between Zika and dengue pseudotype neutralization half-maximum inhibitory concentration (IC$_{50}$) values. IC$_{50}$ values for all dengue serotypes were pooled for the analysis. Significance of the regression model was determined using an F-statistic with 1 and 10 d.f. All measurements were performed in a single experiment. No power analysis was carried out to predetermine an appropriate sample size for this experiment.

For FIG. 10D, fold improvement over IVIG, by assay (ELISA or opsonophagocytosis) was tested using a one-sample Wilcoxon signed rank test, with the null hypothesis that the median equals 1, that is, $H_0$=1. For each assay, all individual serotypes were pooled a single Wilcoxon signed rank test. Values for each individual serotype were generated by dividing the mean of duplicate rPIG measurements by the mean of duplicate IVIG measurements. All measurements were performed in a single experiment. No power analysis was carried out to predetermine an appropriate sample size for this experiment.

For FIG. 10E, Welch's t-tests were used to compare colony forming units (CFU) Hib per ml between test groups and d.f. were 7.87 for IVIG+rHIG/rPIG (500 mg kg$^{-1}$) and 7.13 for IVIG+rHIG/rPIG (200 mg kg$^{-1}$) in peritoneal fluid, and were 10.87 for IVIG+rHIG/rPIG (500 mg kg$^{-1}$) and 8.03 for IVIG+rHIG/rPIG (200 mg kg$^{-1}$) in blood. All measurements were performed in a single experiment. No power analysis was carried out to predetermine an appropriate sample size for this experiment.

For FIG. 11B, linear mixed effects models were used to compute P values for each of the four cell types, with group and concentration as fixed effects and PBMC donor as a random effect to account for the dependence of repeated measures: the d.f. were 31 for each of the four models. All measurements were performed in a single experiment. No power analysis was carried out to predetermine an appropriate sample size for this experiment.

For FIG. 11C and FIG. 48A-48B, Kaplan-Meier survival models were fit on time to mortality and pairwise log-rank tests were performed to compare median survival between treatment groups. All measurements were performed in a single experiment. No power analysis was carried out to predetermine an appropriate sample size for this experiment.

For FIG. 11D and FIGS. 49A-49B, linear mixed effects models were used to compute P values for trends in CD45$^+$ cell counts in each of the four GVH experiments (2 PBMC donors×2 drug dosing regimens=4 experiments) with day as a fixed effect and PBMC donor as a random effect to account for the dependence of repeated measures. A Wilcoxon rank sum test was used to compare CD45$^+$ cell counts on day 9 for saline negative control versus rhATG and saline negative control versus rabbit-ATG, in each of the four GVH experiments (2 PBMC donors×2 drug dosing regimens=4 experiments). No power analysis was carried out to predetermine an appropriate sample size for this experiment.

For FIGS. 23A-23C, 33A-33B, 40A-40B and 41A-41B, it was assessed whether batch-to-batch variation was more significant than the variability inherent to the assays used to make the measurements.

For rCIG pseudotype neutralization assays (FIG. 23A-23C), Feltz and Miller's asymptotic test was used to determine whether the coefficient of variation of three bioproduction batch IC$_{50}$ measurements (18%) was different from the coefficient of variation of eight $IC_{50}$ measurements on a fourth bioproduction batch (17%).

To assess batch variation in antibody sequence content, the Wilcoxon rank sum test was used to test whether the Jaccard or Morisita indices from PCR replicates from each bioproduction batch came from the same populations as the Jaccard or Morisita indices among bioproduction batches. Sequencing was performed in a single experiment. No power analysis was carried out to predetermine an appropriate sample size for this experiment.

Data Availability

Plasmid and cloning insert sequences are available on GenBank (GA1 backbone, GenBank accession number MW079271; GA1 product, GenBank accession number MW079272; synthetic amplicon insert, GenBank accession number MW079275; GA2 product, example plasmid sequence provided as GenBank accession number MW079273; PMD-4681, GenBank accession number MW079274. Sequencing data are available in the Short Read Archive under project identifier PRJNA649279.

Methods

Sourcing Human Materials

Local ethical regulations were followed and informed consent was obtained for all human sample collection.

rCIG: A contract research organization (CRO; Access Biologics, New Orleans, La., USA) recruited under sample collection protocol #PRO00026464 (Advarra, Columbia, Md., USA) approved by Institutional Review Board (IRB) and included if donors were 12-46 days (average 24 days+/−14 days) from the onset of two or more COVID-19 symptoms (fever, cough, shortness of breath, sore throat, and pneumonia). Sixty mL of whole blood was collected in ACD tubes, de-identified, and transported overnight to GigaGen for processing. 16 donors with high SARS CoV-2 Spike antigen-specific antibodies by ELISA (as described below) were included in rCIG and were predominantly Caucasian (87.5%), female (75%), aged 49 (+/−17 years), collected 21 days (+/−6 days) from onset of symptoms, and were approximately equally distributed, with 6 donors with 2 symptoms, 6 donors with 3 symptoms, and 4 donors with 4 symptoms.

rHIG: A contract research organization (BloodCenter Wisconsin, Milwaukee, Wis., USA) vaccinated two donors (Donor 1, a 26-year-old Caucasian female, and Donor 2, a 21-year-old Asian male) with PedvaxHIB vaccine (Merck, Kenilworth, N.J., USA). Leukapheresis was performed eight or nine days later to obtain PBMCs. In parallel, plasma was isolated from separate blood draws on the day of leukapheresis and prior to vaccination. ELISA was performed against Hib (Alpha Diagnostics, San Antonio, Tex., USA; see methods below) on the plasma samples to confirm a response to the vaccine as compared to plasma from the same donors prior to vaccination. Sample collection protocols were approved by IRB protocol #PRO00028063 (Medical College of Wisconsin/Froedtert Hospital IRB) to GigaGen. Informed consent was obtained from all participants and samples were shipped to GigaGen de-identified.

rPIG: A contract research organization (AllCells, Alameda, Calif., USA) vaccinated three donors (Donor 1, 57-year-old Caucasian male; Donor 2, 44-year-old Caucasian male; Donor 3, 35-year-old Caucasian/Asian male) with Pneumovax®23 vaccine (Merck, Kenilworth, N.J., USA). 60 mL blood draw was performed eight days later. Plasma and pan-B cells were isolated from whole blood (see methods below). ELISA was performed against a mixture of all 23 pneumococcal polysaccharides (Alpha Diagnostics, San Antonio, Tex., USA; see methods below) on the plasma samples to confirm response to the vaccine. Sample collection protocols were approved by IRB protocol #7000-SOP-045 (Alpha IRB, San Clemente, Calif., USA) to AllCells. Informed consent was obtained from all participants and samples were shipped to GigaGen de-identified.

Processing Human Materials

For whole blood, PBMCs and plasma were isolated using density gradient centrifugation SepMate tubes with Lymphoprep medium (StemCell Technologies, Vancouver, BC, Canada). To isolate pan-B cells from PBMCs (from either whole blood or a leukopak), the Human EasySep Pan-B Cell Enrichment Kit (StemCell, Vancouver, BC, Canada) was used. After isolation, the cells were cryopreserved using CryoStor® CS10 (StemCell Technologies, Vancouver, BC, Canada). Immediately prior to generating paired heavy and light chain libraries, cells were thawed, washed in cold DPBS+0.5% BSA, assessed for viability with Trypan blue on a disposable hemocytometer (Bulldog Bio, Portsmouth, N.H., USA) or with AOPI on a Cellometer K2 (Nexcelom Bioscience, Lawrence, Mass., USA), and then re-suspended in 12% OptiPrep™ Density Gradient Medium (Sigma, St. Louis, Mo., USA) at 5,000-10,000 cells per μl. This cell mixture was used for microfluidic encapslation as described below.

Immunization of Trianni Mouse® Mice

Local ethical regulations were followed for mouse immunizations, by Antibody Solutions IACUC (Sunnyvale, Calif., USA).

Humanized mice were engineered by Trianni (San Francisco, Calif., USA). Trianni mice were bred and obtained from Charles River Laboratories (Wilmington, Mass., USA). All mice were male and 12-15 weeks old at the start of the immunization process. Antibody Solutions (Santa Clara, Calif., USA) performed all Trianni Mouse immunizations. Local ethical regulations were followed for mouse immunizations by the Antibody Solutions IACUC. The mice were ear marked for identification by the breeder and housed in individually ventilated cages (Innovive, San Diego, Calif., USA) and racks with HEPA filtered air at a density of up to 5 mice per cage. The animal room was lighted entirely with artificial fluorescent lighting, with a controlled 12 h light/dark cycle (7 am to 7 pm light). The normal temperature and relative humidity ranges in the animal rooms were 20-22.2° C. and 30-70%, respectively. The animal rooms were set to have up to 10 air exchanges per hour. Sunnyvale municipal tap water and rodent chow (Teklad Global, Indianapolis, Ind., USA) were provided ad libitum.

rZIG: Two Trianni humanized mice were immunized consecutively weekly with Zika VLP, inactivated Dengue 1, inactivated Dengue 4, inactivated Dengue 3, then inactivated Dengue 2 with alhydrogel/muramyl dipeptide (ALD/MDP) adjuvant. Animals were checked for antibody titer and boosted with Zika VLPs without adjuvant 5 days before harvest (Antibody Solutions, Santa Clara, Calif., USA).

rhATG: Two Trianni humanized mice were immunized weekly with human thymocytes from 5 de-identified specimens acquired from a CRO (Vitalant Research Institute, San Francisco, Calif., USA) for 5 weeks with ALD/MDP adjuvant and boosted on week 6 without adjuvant. Three Trianni mice were immunized weekly for 5 weeks with Pan T cells (StemCell, Vancouver, Canada) in ALD/MDP isolated from PBMCs from 1 de-identified donor (StemCell), checked for an elevated antigen-specific antibody titer, and boosted with the same cells 5 days before harvest without adjuvant (Antibody Solutions, Santa Clara, Calif., USA).

After sacrifice, spleen, lymph nodes, and/or bone marrow were harvested and processed into a single cell suspension.

Samples from multiple mice were pooled together by tissue and pan-B cells were isolated from spleen and lymph node tissue using the EasySep Mouse Pan-B Cell Enrichment Kit (StemCell Technologies, Vancouver, BC, Canada). CD138+ cells were isolated from bone marrow using Miltenyi CD138+ mouse microbeads (Miltenyi, Bergisch Gladbach, Germany). After isolation, the cells were cryopreserved using CryoStor® CS10 (StemCell Technologies, Vancouver, BC, Canada).

Generating Paired Heavy and Light Chain Libraries

Generation of scFv libraries from antibody-producing cells (Adler et al., 2017) comprises three steps: (i) poly(A)+ mRNA capture, (ii) multiplexed overlap extension reverse transcriptase polymerase chain reaction (OE-RT-PCR), and (iii) nested PCR. Briefly, a microfluidic device captures single cells in droplets with a mixture of lysis buffer and oligo dT beads (NEB, Ipswich, Mass., USA). After the cell is lysed and mRNA is bound to the bead, the emulsion is broken, and the mRNA-containing beads are purified. Next, an emulsion is created using OE-RT-PCR reagents and the beads as template. The emulsion is subjected to thermal cycling which creates cDNA, amplifies the IgK and IgG variable regions, and links them together in an scFv format. Then the emulsion is broken and the linked scFv DNA product is extracted and purified. The purified scFv product is then amplified using nested PCR to remove artifacts and add adapter sequences. Depending on the adapter sequences, the product can be used for deep sequencing, yeast display libraries, or full-length CHO expression.

To convert the scFv libraries into full-length CHO expression libraries, nested outer PCR primers were first used to add adapters with overhangs for Gibson assembly to the 5' and 3' ends of the scFv library (for rCIG, this was done after yeast scFv display enrichment, as described in the next section). Then NEBuilder HiFi DNA Assembly Master Mix (NEB, Ipswich, Mass., USA) was used to insert the scFv library into a vector containing a single promoter, a secretory leader sequence for light chain Ig and the remainder of the IgG1 constant region, creating a cloned scFv library. This intermediate library was transformed into *E. coli* and plasmids were purified by either (a) spreading onto LB-ampicillin plates, scraping 0.5-1 million colonies and pooling or (b) inoculating directly into LB-ampicillin broth and growing overnight. Plasmid purification was performed using ZymoPURE II Plasmid Maxiprep Kits (Zymo Research, Irvine, Calif., USA). To create the full-length antibody library, a second Gibson assembly was performed by linearizing the product of GA1 with BamHI-HF (rHIG) or Nhel-HF (rCIG, rPIG, rhATG, and rZIG) (NEB, Ipswich, Mass., USA) and using it as a vector to insert a synthetic amplicon containing a portion of the light chain Ig constant region, a poly(A) signal for light chain Ig, a promoter for the IgG gene and a secretory leader sequence for the IgG gene. The full-length library was then transformed into *E. coli* and spread on LB-ampicillin plates. >0.5 million colonies were combined and plasmid with a ZymoPURE II Plasmid Maxiprep Kits (Zymo Research, Irvine, Calif., USA) was purified to make the full-length recombinant hyperimmune maxiprep library for transfection. When the transformed *E. coli* were inoculated directly into LB-ampicillin broth, a small volume of cells was plated to calculate the total number of transformants. In some cases ampicillin was used for both plates and broth, in other cases carbenicillin was used instead. Paired heavy and light chain libraries were made only once from each sample.

Enrichment for Antigen Binders By Yeast scFv Display

Polyclonal COVID-19 scFv libraries were sorted (Adler et al., 2017) to enrich for relevant sequences. Briefly, yeast surface display scFv libraries were generated using COVID-19 scFv DNA libraries and a custom yeast surface display vector transformed by electroporation into EBY100 yeast strain (MYA-4941; ATCC, Manassas, Va., USA). Surface displayed scFv sequences include a C-terminal myc tag to identify scFv expression with an anti-myc primary (A21281; Thermo Fisher Scientific, Waltham, Mass., USA) and AF488 secondary antibody (A11039; Thermo Fisher Scientific, Waltham, Mass., USA). Binding to antigen was identified by staining with soluble biotinylated SARS CoV-2 receptor binding domain antigen (SPD-C82E9; Acro Biosystems, Newark, Del., USA) at 1200 nM and APC-streptavidin (SA1005; Thermo Fisher Scientific, Waltham, Mass., USA). Stained yeast libraries were sorted on a FACSMelody (BD Biosciences, San Jose, Calif., USA) and double positive (AF488+/APC+) cells were collected. The gating strategy is outlined in Supplementary Figure S2. The collected cells were expanded and sorted again to further enrich the libraries. After the second round of sorting, cells were expanded a third time prior to plasmid isolation with a Zymoprep Yeast Plasmid Miniprep kit (Zymo Research, Irvine, Calif., USA). The plasmid libraries were then used as template for barcoding PCR and subsequent analysis by deep sequencing (Illumina, San Diego, Calif., USA). Plasmid from twice-sorted libraries was used as template for PCR towards full-length CHO antibody expression. Yeast scFv sorting was performed only once from each yeast scFv library.

Cell Line Used for rHIG and rhATG

The adherent Flp-In™-CHO cell line with a genetically integrated FRT site (Thermo Fisher Scientific, Waltham, Mass., USA) was adapted to suspension culture. For all steps in the adaptation process, "Ham's F-12" refers to Ham's F-12 (with L-glutamine, Thermo Fisher Scientific, Waltham, Mass., USA) plus 10% FBS (Thermo Fisher Scientific, Waltham, Mass., USA), and "BalanCD" refers to BalanCD CHO Growth A (Irvine Scientific, Santa Ana, Calif., USA) with 4 mM Glutamax (Thermo Fisher Scientific, Waltham, Mass., USA). To adapt this cell line to suspension, the cells were first passaged into a mixture of 50% Ham's F-12 plus 50% BalanCD in T-flasks. Cells were next passaged into 25% Ham's F-12 plus 75% BalanCD and switched to shaking Erlenmeyer flasks. Cells were then passaged into 10% Ham's F-12, 90% BalanCD+0.2% anti-clumping agent (Irvine Scientific, Santa Ana, Calif., USA) and banked for future use.

Approximately 100 million of the adapted Flp-In CHO cells were transfected per recombinant hyperimmune globulin library using an Amaxa Nucleofector 4D (SG buffer, pulse DU133; Lonza, Basel, Switzerland). These cells were plated into shaking Erlenmeyer flasks and recovered in an incubator at 37° C., 5% $CO_2$, 125 rpm. After 48 hours, the cells were counted to determine viability, cells were seeded at 1 million cells/mL, and selection was started using 600 μg/mL Hygromycin-B (Gemini Bio, West Sacramento, Calif., USA) in fresh media. Cells were counted and media was changed every 2-3 days during the 7-day selection. The libraries were kept on 600 μg/mL Hygromycin-B (Gemini Bio, West Sacramento, Calif., USA) during expansion until viability exceeded 95%. When cells were >95% viable and doubling every 24 hours, the adapted Flp-In™-CHO cell line was banked for liquid nitrogen storage. Before banking, cells were sampled from each library, RNA was purified, and antibody RNA-seq (Illumina, San Diego, Calif., USA) was performed to assess the diversity of the libraries (Table 13 and 17).

Cell Line Used for rPIG, rZIG, and rCIG

A landing pad construct (FIG. 13E, PMD-4681; GenBank accession number MW079274) was designed and cloned at GigaGen. PMD-4681 was based on pFRT-lacZeo (Thermo Fisher Scientific, Waltham, Mass., USA), with some modifications. In place of the LacZ expression construct a cassette was inserted coding for expression of CD34 and GFP. The CD34, GFP, and downstream Zeocin resistance genes (ZeoR present in pFRT-lacZeo) were separated by 2A motifs (T2A or P2A) to allow for translation of three separate polypeptide chains. The CD34 sequence was sourced as a gBlock from IDT (Coralville, Iowa, USA). The GFP sequence was sourced from ATUM (DasherGFP; Newark, Calif., USA).

The GMP suspension CHO line CHOZN® GS−/− was obtained from MilliporeSigma (St. Louis, Mo., USA). PMD-4681 was linearized using ScaI-HF and purified via ethanol precipitation. Cells were transfected with the linearized DNA using Amaxa Nucleofector 4D, SE kit, pulse CM-150 (Lonza, Basel, Switzerland). Cells recovered overnight in an incubator and were plated the next day into minipools at approximately 5,000 cells per well, across ten 96-well plates in selective media. The remaining cells were plated and selected together as a bulk pool control. Wells were topped off with fresh media every seven days until at least 80% confluency was reached.

A total of 236 minipools grew out and were screened in parallel for high GFP expression via flow cytometry and low copy number with a quantitative PCR Copy Number Variation (CNV) assay. Minipools with a copy number less than 2.5 and GFP expression at least 50% of the bulk pool were expanded into shaking adaptation. Expanded pools were re-tested for GFP expression via flow cytometry.

Cells were then adapted to BalanCD CHO Growth A in preparation for plating into semi-solid media. Minipools were deemed fully adapted when cells showed consistent doubling times and high viability (>90%). Adapted cells were plated into semisolid media for the Molecular Devices (Fremont, Calif., USA) ClonePix3 single cell cloning platform. Single cell imaging was obtained on day 0 of cell plating in semisolid media to confirm monoclonality. After 14 days, clonal cell colonies were picked and deposited as one colony per well of a 96-well plate. Each clone was then expanded, re-adapted to selection media, and cryopreserved. Doubling times were calculated and clones with less than a 30-hour doubling time were chosen for further development. Expanded clones were retested for GFP expression and copy number.

Remaining clones were transfected in duplicate using the Gene Pulser Xcell Total System (BioRad, Hercules, Calif., USA) per guidelines from MilliporeSigma (St. Louis, Mo., USA) for use with CHOZN GS with a monoclonal antibody (mAb)-cyan fluorescent protein (FrostyCFP, ATUM, Newark, Calif., USA) construct to test expression titer. CFP expression was evaluated via flow cytometry 3 days post transfection to confirm transfection efficiency >35%. After full selection and recovery, cell lines were tested in a 10-day fed batch TPP shaking production run in duplicate. Titers for candidate cell lines ranged from 50-100 mg/L. A single clone (CSS-1286) was selected to use for recombinant hyperimmune expression.

For transfection of recombinant hyperimmune globilins into CSS-1286, approximately 50 million cells were transfected per recombinant hyperimmune globulin library using the BioRad Gene Pulser Xcell Total System (Hercules, Calif., USA), per guidelines from MilliporeSigma (St. Louis, Mo., USA) for use with CHOZN GS. The cells were plated into T-75 flasks (approximately 10 million cells per flask) and recovered in an incubator at 37° C., 5% $CO_2$ for 72 hours. After 72 hours, the cells were counted to determine viability and then seeded into 100 mL fresh media without glutamine (EX-CELL CD CHO Fusion, MilliporeSigma, St. Louis, Mo., USA) in a 500 mL Erlenmeyer flask. Cells were counted and media was changed every 2-3 days during the ~14-day selection. When cells were >95% viable and doubling every 24 hours, the cell line was banked for liquid nitrogen storage. Before banking, cells were sampled from each library, RNA was purified, and antibody RNA-seq (Illumina, San Diego, Calif., USA) was performed to assess the diversity of the libraries (Tables 9, 11, 14).

Bioproduction of rHIG and rhATG RPP

Adapted Flp-In™-CHO cells stably expressing antibody libraries were grown in media consisting of 90% BalanCD CHO Growth A Medium (Irvine Scientific, Santa Ana, Calif., USA), 9% Ham's F-12 (Thermo Fisher Scientific, Waltham, Mass., USA), 1% FBS (Thermo Fisher Scientific, Waltham, Mass., USA), 4 mM Glutamax (Thermo Fisher Scientific, Waltham, Mass., USA), 0.2% anti-clumping agent (Irvine Scientific, Santa Ana, Calif., USA), 600 µg/mL Hygromycin-B (Gemini Bio, West Sacramento, Calif., USA). Protein production was performed at either small (250 mL) or medium (5 L) scale. For small-scale production, cells were seeded at $1 \times 10^6$ cells/mL into 50 mL media in a 250 mL Erlenmeyer flask and grown at 37° C., 5% $CO_2$, 125 rpm. Cells were continually grown under these conditions and supplemented with 7.5 mL CHO Feed 1 (Irvine Scientific, Santa Ana, Calif., USA) on Days 2, 4 and 7 of the production run. Supernatant was harvested on Day 8 or 9 by centrifugation followed by filtration through a 0.22 µm 250 mL filter bottle (MilliporeSigma, St. Louis, Mo., USA) with 1 µm pre-filter (MilliporeSigma, St. Louis, Mo., USA). Harvested cell culture fluid (HCCF) was stored at 4° C. (if less than 1 week) or at −80° C. (if more than one week) until Protein A purification. For medium-scale production, cells were grown in the same media. Cells were then seeded at $1 \times 10^6$ cells/mL in 2.3 L in a 5 L flask (in duplicate; Day 0). Each flask was fed with 345 mL CHO Feed 1 (Irvine Scientific, Santa Ana, Calif., USA) on Days 2 and 4 of the culture. Cultures were harvested on Day 8 or 9. Each of the four rhATG protein libraries were produced separately.

Bioproduction of rPIG, rZIG, and rCIG RPP

CSS-1286 CHO cells stably expressing antibody libraries were grown in media without glutamine (EX-CELL CHOZN Advanced; MilliporeSigma, St. Louis, Mo., USA). Protein production was performed at either small (250 mL) or medium (5 L) scale. For small-scale production, cells were seeded at $0.5 \times 10^6$ cells/mL into 100 mL media in a 500 mL Erlenmeyer flask and grown at 37° C., 5% $CO_2$, 125 rpm. Cells were continually grown under these conditions and supplemented with 15 mL CHO Feed 1 (MilliporeSigma, St. Louis, Mo., USA) on Day 3, and 10 mL CHO Feed 1 (MilliporeSigma, St. Louis, Mo., USA) on Days 6 and 8 of the production run. Starting on Day 3, glucose was measured each day and supplemented to 6 g/L if below 4 g/L. Supernatant was harvested after cell viability peak and before dropping below 90% viability between Days 9-11, centrifuged and filtered through a 0.22 µm 250 mL filter bottle (MilliporeSigma, St. Louis, Mo., USA) with 1 µm pre-filter (MilliporeSigma, St. Louis, Mo., USA). HCCF was stored at 4° C. (if less than 1 week) or at −80° C. (if more than one week) until Protein A purification. For medium-scale production, cells were grown in the same media. Cells were seeded at 0.5×10$^6$ cells/mL in 2.2 L in a 5 L flask (in duplicate; Day 0). Each flask was fed with 330 mL CHO Feed 1 (Millipore Sigma, St. Louis, Mo., USA) on Day 3 and 220 mL CHO Feed 1 (MilliporeSigma, St. Louis, Mo., USA) on Days 6 and 8 of the production run. Starting on Day 3, glucose was measured each day and supplemented to 6 g/L if below 4 g/L. Cultures were harvested on Day 10-12.

RPP Protein Production and Characterization

After harvest, HCCF was purified using a 1 mL or 5 mL HiTrap Mab Select PrismA Protein A Column (GE Life Sciences, Marlborough, Mass., USA) using the following buffers: 1×PBS pH 7.0-7.4 (Teknova, Hollister, Calif., USA) for running and wash buffer, 0.1 M Citrate Buffer, pH 3.0 (Teknova, Hollister, Calif., USA) for elution buffer, 1 M Sodium Citrate, pH 6.0 (Teknova, Hollister, Calif., USA) for neutralization. The column was washed at 10 mL/min until UV was stable, then sample was injected at 5 mL/min. The column was washed with 10 column volumes at 10 mL/min. Protein was eluted using elution buffer at 5 mL/min, collecting 1 mL fractions. Fractions were then pooled. Pooled sample was neutralized slowly using 1 M Sodium Citrate to a pH of ~5.0. Neutralized sample was centrifuged at 5000×g to remove any precipitation, then dialyzed overnight into 0.2 M glycine, pH 4.5 (Teknova, Hollister, Calif., USA) using a 20K MWCO Dialysis Cassette (Thermo Fisher Scientific, Waltham, Mass., USA). Buffer was changed once, then sample was removed, spun down to remove any precipitant, filtered through a 0.22 μm filter and quantified by A280 (NanoDrop; Thermo Fisher Scientific, Waltham, Mass., USA). For rhATG, each of the four libraries were purified by Protein A separately and then equally pooled based on mass.

Purity of the protein was determined by SEC-HPLC. 20 μg of material at 1 mg/mL was injected over a 300 Å, 2.7 μm, 7.8×300 mm size exclusion column (Agilent, Santa Clara, Calif., USA) using a mobile phase of 25 mM phosphate, 200 mM NaCl pH 7.0 with 10% acetonitrile at 1 mL/min. The percent monomer was determined by integrating the product peaks and reporting the percent area corresponding to ~150 kDa. The product was further characterized by running 2 μg on a 12% SDS-PAGE gel under reduced and non-reduced buffering conditions, and imaged after staining with SimplyBlue SafeStain (Thermo Fisher Scientific, Waltham, Mass., USA).

Medium-Scale Production, Polishing, and Stress Testing of rCIG

For bioreactor production at 3 L scale, a seed train protocol was devised to mimic the number of passages required for production at up to 2,000 L scale. For each bioreactor production run, a single vial of rCIG cell bank was thawed at 37° C. and the contents of the vial were transferred to 10 mL of EX-CELL CD CHO Fusion media (MilliporeSigma, St. Louis, Mo., USA). The cells were then centrifuged for 5 minutes at 500×g. The supernatant was aspirated and discarded, and the cells were re-suspended in 5 mL of EX-CELL CD CHO Fusion. The entire volume of cells was seeded into a 250 mL non-baffled, vented shake flask at a final volume of 50 mL. The shake flask was incubated at 37° C., 5% CO$_2$, ≥80% humidity and 125 RPM (25 mm orbital diameter). Three days post thaw the viable cell density (VCD) was 4.0-6.0×10$^6$ vc/mL with a viability ≥90%. At this point the cells were passaged using EX-CELL CD CHO Fusion into a 1000 mL shake flask at a seeding density of 0.4×10$^6$ vc/mL. In a similar manner, the culture was passaged once more into a 1000 mL shake flask, and then two more times into 1000 mL spinner flasks. The final passage before bioreactor inoculation was done in EX-Cell Advanced CHO Fed Batch media (Millipore Sigma, St. Louis, Mo., USA).

Three days after completing the fifth passage, three 3 L Mobius single-use bioreactors (MilliporeSigma, St. Louis, Mo., USA) were seeded using the culture. Each bioreactor was prepared with 1300 mL of EX-Cell Advanced CHO Fed Batch media and then seeded at a VCD of 0.4±0.1×10$^6$ vc/mL. Additional media was added if required to have an initial working volume of 1600 mL. Each bioreactor was controlled using the following set points: temperature setpoint Days 0-4 setpoint 37° C.; temperature Days 4-14 setpoint 32° C.; dissolved oxygen setpoint 30%; pH Days 0-3 7.0±0.2; pH Days 3-14 7.0±0.1. EX-Cell Advanced CHO Feed (MilliporeSigma, St. Louis, Mo., USA) and Cellvento 4Feed COMP (MilliporeSigma, St. Louis, Mo., USA) were added on Days 3, 5, 7, 9, and 11. Feed volumes were determined as a percentage of the current bioreactor volume, such that EX-Cell Advanced CHO Feed was added at 4% of the volume of the bioreactor and Cellvento 4Feed COMP was added at 2% of the volume of the bioreactor. Glucose levels were monitored daily, and starting on Day 3 were maintained above 4 g/L by adding a 45% Glucose solution until levels reached 6 g/L. The bioreactors were harvested after 14 days of culture. 5-10 million cells were collected from each bioreactor for antibody repertoire sequencing (FIG. 23A-23B).

For purification and polishing, an empty column was packed with MabSelect Sure PrismA resin (Cytiva, Marlborough, Mass., USA) and equilibrated with 20 mM phosphate, 150 mM NaCl, pH 7.4. Harvested cell-culture fluid was loaded at 20-40 g/L, washed with 20 mM phosphate, 500 mM NaCl, pH 7.4 and 50 mM phosphate, pH 6.0, and eluted with 50 mM sodium acetate, pH 3.5. The pH of the Protein A eluate was adjusted to 3.5 using 1 M acetic acid and the material was subjected to a 1 hour viral hold, after which it was adjusted to pH 5 using 1 M Tris-HC1, pH 9 and filtered to remove particulate. A second column was packed with POROS XS (Thermo Fisher Scientific, Waltham, Mass., USA) cation exchange (CEX) resin and equilibrated with 50 mM sodium acetate, pH 5.0. The filtered neutralized low pH hold pool was loaded on this column at 14-21 g/L, washed with 50 mM sodium acetate, 100 mM sodium chloride, pH 5.0, and eluted over a 20 CV gradient to 50 mM sodium acetate, 400 mM sodium chloride, pH 5.0. The product eluted with several distinct peaks, of which only the first was collected. The pooled CEX eluate was diluted with 20 mM tris-acetate, pH 7.4 to <8 mS/cm, then flowed through a Sartobind Q (Sartorious, Gottingen, Germany) anion-exchange membrane. The flowthrough was concentrated using a 30K molecular weight cutoff cellulose acetate tangential flow filtration cartridge (MilliporeSigma, St. Louis, Mo., USA), then diafiltered with 200 mM glycine pH 4.5 and sterile-filtered.

For stress testing, polished rCIG at 15 mg/mL in 200 mM glycine, pH 4.5 was incubated at 40° C. for 14 days. Separately, aliquots were subjected to 3 or 25 freeze-thaw cycles in a −80° C. freezer or dry ice/ethanol bath. The stressed samples were run on SEC-HPLC and SARS CoV-2 S1 ELISA and compared to a control that was stored at 4° C.

Deep Antibody Repertoire Sequencing

Deep antibody sequencing libraries were prepared as described previously (Adler et al., 2017), quantified using a KAPA quantitative PCR Illumina Library Quantification Kit (Roche, Mannheim, Germany), and diluted to 17.5 pM. Libraries were sequenced on a MiSeq (Illumina, San Diego, Calif., USA) using a 500 cycle MiSeq Reagent Kit v2, according to the manufacturer's instructions. To make sequencing libraries, tailed-end PCR was used to add Illumina sequencing adapters to the 5' and 3' ends of the constructs of interest. For scFv libraries (after droplet emulsion breaking or yeast plasmid isolation), a forward read of 340 cycles was used to capture the light chain CDR3 sequence, and a reverse read of 162 cycles was used to capture the linked heavy chain CDR3 sequence. For CHO libraries, the full-length heavy chain sequence was obtained using overlapping forward and reverse reads of 251 cycles. To determine the number of antibody clones in the final CHO cell libraries and for generating the clonal cluster analysis figures, 5-10 million CHO cells were harvested prior to a production run. For the batch-to-batch variation analysis, 5-10 million CHO cells were harvested at the conclusion of the replicate production runs, and a median of 855,746 sequence reads were obtained for each sequencing library (range: 658,013 to 1,113,968).

To determine the Fc subtype of a library, the heavy chain was amplified with a primer that binds further into the constant domain to add the Illumina sequencing adapter to the 3' end; the first 60 bp of the constant domain was sequenced to determine the subtype, which was linked to the corresponding CDR3H that was simultaneously sequenced. Each library was sequenced one time.

Sequence analysis, including error correction, reading frame identification, and FR/CDR junction calls was performed using our previously reported bioinformatics pipeline (Adler et al., 2017). Reads with E>1 (E is the expected number of errors) were discarded, to retain sequences for which the most probable number of base call errors is zero. Clones are defined as sequences with unique CDR3 amino acid sequences (CDR3K+CDR3H for scFv clones, CDR3H only for CHO clones). A more conservative clone count is also provided (combined CDR3), where unique clones were combined if they had 1 amino acid difference for 5-6 amino acid long CDR3s, or if they had 1-2 amino acid differences for >6 amino acid long CDR3s; this applies to a concatenation of CDR3K+CDR3H for scFv clones or CDR3H only for CHO clones).

For the clonal cluster analysis, USEARCH (Edgar, 2010) to compute the total amino acid differences between each pairwise alignment of full-length heavy chain sequences with abundance ≥0.01% in each CHO cell bank. Then the R package graph (version 1.2.4.1) was used to generate clustering plots for the pairwise alignments. The sequences were represented as "nodes", with the color (and sometimes shape) defined in the respective figures. The size of the nodes reflects the frequency of the clone (small, <0.1%; medium, 0.1-1%; large, >1%). "Edges" are the links between nodes, which indicate pairwise alignments with ≤5 amino acid differences. The layout_with_graphopt (niter=3000, charge=0.03) option was used to format the output. To visualize the sequences within a library, the top five clusters containing the highest number of connected nodes/sequences were selected. These sequences were aligned and visualized as sequence logos using the R package msa 1.16.0.

To assess antibody repertoire overlap between libraries, Jaccard and Morisita indices were computed using the R package tcR (version 2.3.2). Shannon entropy and Simpson diversity indices were calculated using the R package vegan 2.5.5. Heavy chain V and J gene identities were measured using the USEARCH[49]-local algorithm with the germline database as reference. For the heatmaps showing the pairing of VH and VL genes, the germline divergence histograms, and the histograms showing the distribution of heavy chain CDR3 length, each unique clone was plotted once (i.e., not scaled by sequencing read abundance).

To estimate the error rate due to RNA/cDNA amplification, a region of the heavy chain constant domain from the rCIG libraries (the region used to determine the heavy chain subtype) was sequenced, after performing the same amplification process as the final polyclonal libraries. The total error rate for this region was 0.3%, then using Illumina's quality (Q) score for each sequenced base, the estimated sequencing error rate for this region was determined to be 0.052%. Thus, the estimated maximum error rate from our amplification process is 0.3%−0.052%=0.248% (which may still contain some error due to natural sequence variation in the constant domain).

Sequencing data are available in the Short Read Archive (SRA) under project identifier PRJNA649279.

In Vitro Efficacy Studies rCIG: Anti-SARS CoV-2 antibody reactivities were measured using a protocol based on published ELISA methods (Amanat et al., 2020). In brief, SARS CoV-2 Spike and RBD (wild type and variant proteins; Sino Biological, Wayne, Pa., USA) were used to coat ELISA plates at 2 µg/mL. Serial dilutions of antibody preparations including test plasma and recombinant products, positive control monoclonal antibodies (CR3022; Absolute Antibody, San Diego, Calif., USA, and SAD-535; Acro Biosystems, Newark, Del., USA) and negative control IVIG (Gamunex; Grifols, S. A., Sant Cugat, Spain) were performed in dilution buffer (1×PBS+0.05% Tween+0.3% dry milk) in singlet. Quantitative measurements were performed on a plate reader (Molecular Devices, Fremont, Calif., USA) and analyzed using Softmax Pro (Version 7.1; Molecular Devices, Fremont, Calif., USA) to calculate the EC50 concentrations of samples. The concentration of total IgG was calculated by Cedex Bioanalyzer Human IgG assay (Roche, Mannheim, Germany).

Blocking of binding between Spike RBD and ACE2 was demonstrated by ELISA (BPS Bioscience, San Diego, Calif., USA). In brief, SARS CoV-2 Spike RBD protein was coated onto an ELISA plate, serial dilutions of test plasma and recombinant products, positive control monoclonal antibodies (CR3022; Absolute Antibody, San Diego, Calif., USA, and SAD-535; Acro Biosystems, Newark, Del., USA) and negative control IVIG (Gamunex; Grifols, S. A., Sant Cugat, Spain) were performed in singlet in dilution buffer (1×PBS+0.05% Tween+0.3% dry milk). After incubation, ACE2-His was added at 2.5 ng/mL. After further incubation, anti-His-horseradish peroxidase was added. The plate was developed for a chemiluminescent readout. Quantitative measurements were performed on a plate reader (Molecular Devices, Fremont, Calif., USA) and analyzed using Softmax Pro (Version 7.1; Molecular Devices, Fremont, Calif., USA) to calculate the EC50 concentrations of samples.

The SARS CoV-2 pseudotype virus neutralization assay was performed in a 96-well plate using ACE2 expressing HEK-293T target cells (CRL-11268; ATCC, Manassas, Va., USA) transiently transfected with TMPRSS-2 expression plasmid. The GFP reporter pseudotype virus expressing SARS-CoV-2 spike (Integral Molecular, Philadelphia, Pa., USA) was mixed with test plasma, test rCIG, positive control monoclonal antibodies (CR3022; Absolute Antibody, San Diego, Calif., USA, and SAD-S35; Acro Biosystems, Newark, Del., USA) and negative control IVIG (Gamunex; Grifols, S. A., Sant Cugat, Spain) at a five-fold dilution series in singlet. After one-hour incubation, 4×10$^4$ cells target cells were added to each well and incubated at 37° C. for 48 hours. After incubation, the media was removed from all wells without disturbing the adherent cells. TrypLE (Thermo Fisher Scientific, Waltham, Mass., USA) was added to each well and incubated for 3 minutes at 37° C. Media was added to stop trypsinization and cells were stained with DAPI and passed through a 30-40 µm filter (Pall Corporation, Port Washington, N.Y., USA) before quantifying GFP+ cells using a Cytoflex LX (Beckman Coulter, Indianapolis, Ind., USA). Flow cytometry data were analyzed by FlowJo (BD Biosciences, San Jose, Calif., USA).

SARS CoV-2 microneutralization assays were performed at the Regional Biocontainment Laboratory at Duke University Medical Center (Durham, N.C., USA) in a 96-well plate format using Vero E6 cells (CRL-1586; ATCC, Manassas, Va., USA) infected with 100 TCID50 dose of the 2019-nCoV/USA-WA1/2020 strain. Test and control samples were initially diluted to 1:50, then a 12-step, two-fold serial dilution of test antibodies was performed before infection of the cells; every test or control was run in duplicate. IVIG (Gamunex; Grifols, S. A., Sant Cugat, Spain) was used as negative control. Cell-only control wells were included alongside virus-only treated wells. Following 4 days of infection, culture media was removed, and cell monolayer was fixed with 10% neutral buffered formalin (NBF) and stained with 0.1% Crystal Violet. Absorbance at 590 nm or visual inspection was used to measure the monolayer condition/level of infection. Neutralization was reported as the lowest concentration of sample that prevents cytopathic effect in the monolayer of cells.

rZIG: Zika- and Dengue-specific antibodies were measured by ELISA. A 96-well microtiter plate was coated with either 2 µg/ml Zika or Dengue Serotype 1, 2, 3, or 4 recombinant envelope proteins (ProSpec Bio, East Brunswick, N.J., USA) in 1× carbonate coating buffer (BioLegend, San Diego, Calif., USA) and incubated overnight at 4° C. After blocking the coated plate with ultrablock buffer (Bio-Rad, Hercules, Calif., USA) and washing with PBS+ 0.05% Tween-20 (Teknova, Hollister, Calif., USA), eight-step three-fold serial dilutions in assay buffer (1×PBS+ 0.05% Tween+0.3% dry milk) were performed on rZIG-IgG1, rZIG-LALA, Zika/Dengue+ serum positive control (Seracare, Milford, Mass., USA), and a negative control IVIG (Gamunex; Grifols, S. A., Sant Cugat, Spain). Dilutions were added in duplicate and incubated at 37° C. for 1 hour. Next, 1:2500 secondary rabbit anti-human IgG horseradish peroxidase conjugate (Southern Biotech 6140-05, Birmingham, Ala., USA) was added, and the plate was washed and developed using 3,3',5,5'-tetramethylbenzidine (TMB) substrate solution (Thermo Fisher Scientific, Waltham, Mass., USA). The reaction was halted after 8 minutes using sulfuric acid stopping solution (Southern Biotech, Birmingham, Ala., USA). Quantitative absorbance measurements were performed on a SpectraMax i3x plate reader (Molecular Devices, Fremont, Calif., USA) at 450 nm and 620 nm. Standard curves (OD450-620) were artificially set to max out at 2.97 absorbance value. EC50 values were calculated by non-linear regression analysis using GraphPad Prism v8 (San Diego, Calif., USA).

Zika and Dengue in vitro pseudotype neutralization assays were performed at Vitalant Research Institute (VRI, San Francisco, Calif., USA). rZIG, a Zika/Dengue-specific immune sera (UWIS; de-identified sample screened positive for Zika and Dengue 1-4 by University of the West Indies), monoclonal antibody positive control (UWI-mAb1; IgG1 isotype cloned from de-identified donor by University of the West Indies, found to be cross-reactive to Zika and Dengue 1-4), and IVIG negative control (Gamunex; Grifols, S. A., Sant Cugat, Spain) were co-incubated with reporter virus particles (RVPs; Integral Molecular, Philadelphia, Pa., USA) expressing both luciferase and flavivirus-specific glycoproteins as previously described. Briefly, BHK/DC-SIGN cells (CRL-325; ATCC, Manassas, Va., USA) were seeded in black 96-well plates and then incubated with a 7-step, 3-fold serial dilution of antibodies pre-incubated for one hour at 37° C. with RVPs and tested in duplicate. After 72 hours cells were lysed and luciferase activity measured using lysis buffer and firefly luciferase substrate following manufacturer's guidelines (Promega, Madison, Wis., USA). Infection-induced relative light units (RLU) in the presence of test articles were calculated as the RLU of the test article divided by the RLU of a no-serum control infection. The amount of protein required to inhibit 50% of the maximum untreated Zika or Dengue RLUs (IC50) was calculated by non-linear regression analysis using GraphPad Prism v8 (San Diego, Calif., USA).

Zika pseudotype assays for in vitro antibody-dependent enhancement (ADE) were performed at VRI. rZIG, the Zika/Dengue-specific immune sera UWIS, the monoclonal antibody positive control UWI-mAb1, and IVIG negative control (Gamunex; Grifols, S. A., Sant Cugat, Spain) were serially diluted and co-incubated with Zika pseudotype RVPs at 37° C. for 1 hour before addition to K562 chronic myelogenous leukemia cells (CCL-243; Manassas, Va., USA) in U-bottom 96-well plates in triplicate. After a 72 hour incubation at 37° C., cells were harvested, lysed, and infection-induced relative light units (RLU) in the presence of test articles were calculated as the RLU of the test article divided by the RLU of a no antibody control infection (to determine the reported fold-increase in infection).

rHIG: The Human Anti-Hib-PRP IgG ELISA kit (#980-100-PHG, Alpha Diagnostics, San Antonio, Tex., USA) was used for anti-Hib ELISA titers. Serial dilutions of test articles were performed in Low NSB (non-specific binding) sample diluent in singlet. IVIG (Gamunex; Grifols, S. A., Sant Cugat, Spain) was used as a reference control. Quantitative measurements were performed on a plate reader (Molecular Devices, Fremont, Calif., USA) at 450 nm. EC50 values were calculated using SoftMax Pro v8 (Molecular Devices, Fremont, Calif., USA).

In vitro serum bactericidal assay neutralization studies for Hib were performed at ImQuest (Frederick, Md., USA). The *Haemophilus influenzae* strain ATCC 10211 was obtained from ATCC (Manassas, Va., USA) as a lyophilized stock and was propagated as recommended by the supplier. The Eagan strain was obtained from Zeptometrix (Buffalo, N.Y., USA). Colonies from an overnight incubation on chocolate agar plates were inoculated into growth media (Brain Heart Infusion, or BHI broth; BD Biosciences, San Jose, Calif., USA, with 2% Fildes enrichment; Remel, San Diego, Calif., USA) and allowed to achieve an optical density of 625 nm ($OD_{625}$) of approximately 0.4. The culture was adjusted to an $OD_{625}$ of 0.15, which is equivalent to approximately $5 \times 10^8$ colony forming units (CFU)/mL. The culture was further diluted to $5 \times 10^4$ CFU/mL in dilution buffer (Hanks Balanced Salt Solution; Gibco, Waltham, Mass., USA, with 2% Fildes enrichment; Remel, San Diego, Calif., USA). The density of the bacterial culture used in the assay was confirmed by plating 50 µL of the $5 \times 10^3$ and $5 \times 10^2$ dilutions in duplicate on chocolate agar and enumerating the colonies following incubation at 37° C./5% CO2 for 24 hours. rHIG and IVIG (Gamunex; Grifols, S. A., Sant Cugat, Spain) reference control were diluted three-fold in buffer, starting at 200 µg/mL such that a total of ten total dilutions were evaluated in singlet. 10 µL of each dilution of test article was added in duplicate to a 96-well microtiter plate. ATCC 10211 bacteria at a concentration of approximately $5 \times 10^4$ CFU/mL were then added to the plate in a volume of 20 µL, such that the total in-well bacterial density would be $1 \times 10^4$ CFU/20 µL. Following an incubation of 15 minutes at 37° C./5% CO2, 25 µL of baby rabbit complement (Pel-Freez; Rogers, Ark., USA) and 25 µL of dilution buffer was added to each well. The plate was incubated at 37° C./5% CO2 for 60 minutes. Following the incubation, 5 µL of each reaction mixture was diluted in 45 µL of dilution buffer and the entire 50 µL was plated on chocolate agar plates. The plates were incubated for approximately 16 hours at 37° C./5% CO2. Following incubation, bacterial colonies were enumerated. The fold-dilution of the test article that killed >50% of the bacteria is the serum bactericidal index (SBI).

rPIG: The Human Anti-S. Pneumococcal vaccine (Pneumovax/CPS23) IgG ELISA kit (Alpha Diagnostics #560-190-23G, San Antonio, Tex., USA) was used in parallel with the human anti-S. pneumoniae CWPS/22F IgG ELISA kit (#560-410-C22, Alpha Diagnostics, San Antonio, Tex., USA) for initial assessment of anti-pneumococcal titers against a pool of all 23 polysaccharides included in the vaccine.

Serotype-specific antibodies were measured by ELISA and opsonophagocytosis. The concentrations of serotype-specific IgG antibody were calculated using the standard reference serum, lot 007SP (National Institute for Biological Standards and Control; Hertfordshire, UK), using the standardized pneumococcal reference ELISA as previously described. Briefly, 96-well flat-bottomed microtiter plates were coated with capsular polysaccharide antigens (LGC Standards, Teddington, UK) from pneumococcal serotypes 1, 3, 4, 5, 6A, 6B, 7F, 9V, 12F, 14, 18C, 19A, 19F, 22F, 23F, and 33F. All samples were tested in duplicate and double absorbed with CWPS and with purified serotype 22F polysaccharide to neutralize the anti-cell wall polysaccharide and nonspecific homologous antibodies to serotype 22F, except for the 22F assay which was absorbed with CWPS Multi, as described in the WHO reference ELISA protocol. Plates were washed, and a titration of rPIG and reference control IVIG (Gamunex; Grifols, S. A., Sant Cugat, Spain) was performed. Plates were incubated and washed again, and prediluted alkaline phosphatase-conjugated goat anti-human IgG (Thermo Fisher Scientific, Waltham, Mass., USA) was added to each well. After another incubation, the plates were washed a final time and p-nitrophenyl phosphate substrate (MilliporeSigma, St. Louis, Mo., USA) was added. Following a final incubation, the reaction was stopped by adding 3 M NaOH (Thermo Fisher Scientific, Waltham, Mass., USA) to each well. Plates were read using a microtiter plate reader (SPECTROstar Omega; BMG Labtech, Buckinghamshire, UK) at 405 and 620 nm.

The opsonophagocytic indices (OI) to the same pneumococcal serotypes were evaluated by multiplexed opsonophagocytic assay, as previously described. In brief, frozen aliquots of target pneumococci were thawed, washed twice with opsonization buffer B (HBSS with Ca and Mg, 0.1% gelatin, and 10% fetal bovine serum), and diluted to the proper bacterial density (approximately $2 \times 10^5$ CFUs/mL each serotype). Equal volumes of four bacterial suspensions chosen for simultaneous analysis were pooled. Duplicate serially diluted test articles (20 µL/well) were mixed with 10 µL of bacterial suspension in each well of a microplate. After 30 minutes of incubation at room temperature with shaking at 700 rpm, 10 µL of 3- to 4-week-old rabbit complement (Pel-Freeze, Rogers, Ark., USA) and 40 µL of differentiated HL60 cells ($10^7$ cells; CCL-240, ATCC, Manassas, Va., USA) were added. Plates were incubated in a 37° C./5% CO2 incubator with shaking at 700 rpm. After being incubated for 45 minutes, plates were placed on ice for 20 minutes, and an aliquot of the final reaction mixture (10 µL) was spotted onto four different Todd-Hewitt broth with 0.5% yeast extract and 0.75% agar (THY) plate. When the fluid was absorbed into the agar, an equal volume of overlay agar containing one of four antibiotics (optochin, spectinomycin, streptomycin, or trimethoprim) was applied to each THY agar plate. After overnight incubation at 37° C., the number of bacterial colonies in the agar plates was enumerated. IVIG was used as reference control (Gamunex; Grifols, S. A., Sant Cugat, Spain). The OI was defined as the test product dilution that kills 50% of bacteria and was determined by linear interpolation.

rhATG: To assess relative amount and specificity of rhATG, an ELISA was performed on antigens known to be expressed on thymocytes and previously described as having rabbit-ATG reactivity.[41] Rabbit-ATG positive control was from Sanofi Genzyme (Thymogobulin; Cambridge, Mass., USA). T cell antigens (CD3, CD4, CDS, CD7, CD8, CD16a, CD32a, CD45, CD81, CD85 CD95) were purchased from Sino Biological (Wayne, Pa., USA) and individually coated onto 96-well ELISA plates (Thermo Fisher Scientific, Waltham, Mass., USA) at 1 µg/mL in 1× carbonate coating buffer (BioLegend, San Diego, Calif., USA). After an overnight incubation at 4° C., coated plates were washed and blocked (Bio-Rad, Hercules, Calif., USA) for 1 hour. Polyclonal products were diluted to 200 µg/mL of total IgG and an 8-step 1:3 titration in assay buffer (1×PBS+0.05% Tween+0.3% dry milk) was performed. The antibody titrations were added to each antigen and incubated for 1 hour at 37° C. 1:2500 polyclonal HRP goat anti-rabbit IgG (E28002; Novodiax, Hayward, Calif., USA) or 1:2500 mouse anti-human IgG HRP (109-035-088; Jackson ImmunoResearch, West Grove, Pa., USA) were diluted 1:2500 and incubated on the plate for 1 hour. Plates were washed, developed using 1-step ultra TMB substrate (Thermo Fisher Scientific, Waltham, Mass., USA), and stopped with 1 N HCl. Plates were read by a spectrophotometer (Molecular Devices, Fremont, Calif., USA) at 450 nm and analyzed with Softmax Pro (v7; Molecular Devices, Fremont, Calif., USA).

To assess off-target antibody binding a red blood cell antigen binding assay was perfromed, using the Capture-R kit (Immucor, Norcross, Ga., USA). Using a dilution of test article (Thymoglobulin or rhATG) or positive control from the Immucor kit, samples were added to the plate and incubated for 1hr at 37° C. in singlets. ELISA plates were washed and incubated with 1:2500 polyclonal HRP goat anti-rabbit IgG (E28002; Novodiax, Hayward, Calif., USA) or 1:2500 mouse anti-human IgG HRP (109-035-088; Jackson ImmunoResearch, West Grove, Pa., USA). Subsequently, plates were washed and developed with ultra-TMB substrate (Thermo Fisher Scientific, Waltham, Mass.) and the reaction was stopped with 3 M NaOH (Thermo Fisher Scientific, Waltham, Mass., USA) and read the plate on a spectrophotometer at 450 nm.

To determine in vitro function of rhATG, peripheral blood mononuclear cells were isolated from whole blood acquired from a CRO (StemCell Technologies, Vancouver, Canada) and frozen. PBMCs were thawed, washed, and plated at $1.5 \times 10^5$ cells/well in singlets. Thymoglobulin or rhATG were diluted five-fold starting at 40 µg/mL total IgG and co-incubated with each donor PBMC. Cells were co-incubated overnight at 37° C. After incubation, cells were washed, FcR blocked, and stained for CD45 (clone H130; BioLegend #304008, San Diego, Calif., USA), CD3 (clone UCHT1; BioLegend #300439, San Diego, Calif., USA), CD8 (clone BW135/80; Miltenyi #130-113-157, Bergisch Gladbach, Germany), CD20 (clone 2H7; BioLegend, San Diego, Calif.), CD56 (clone 5.1H11; BioLegend #362509, San Diego, Calif., USA), and CD16 (clone 3G8; BioLegend #302017, San Diego, Calif., USA). 1 µL of each antibody was used per $1.5 \times 10^5$ cells. Flow cytometry was performed using a Cytoflex LX (Beckman Coulter, Indianapolis, Ind., USA) with CytExpert (2.3.1.22) and a consistent collection volume of 150 seconds per well was implemented for every sample. The data were analyzed by FlowJo v10 (BD Biosciences, San Jose, Calif., USA). Cell counts after antibody co-incubation relative to no-antibody control (% cells) were calculated. Results were graphed in GraphPad Prism v8 (San Diego, Calif., USA). The gating strategy is outlined in FIG. 50A.

In Vivo Mouse Efficacy Studies

Ethical approval was obtained by Institutional Animal Care and Use Committees (IACUCs) at either SSI (Copenhagen, Denmark) for the Hib challenge model or Jackson Laboratory (Sacramento, Calif., USA) for the GVH model.

IVIG+rHIG/rPIG: For IVIG+rHIG/rPIG in vivo challenge studies, the *Haemophilus influenza* strain ATCC 10211 was grown on chocolate agar plates overnight at 35° C. and 5% CO2. Single overnight colonies were resuspended in sterile saline to $1.5 \times 10^8$ CFU/mL. This suspension was diluted in BHI broth to $1.5 \times 10^7$ CFU/mL and further diluted in BHI broth with 5% mucin and 2% hemoglobin to $1.5 \times 10^4$ CFU/mL. In an IACUC-approved protocol (SSI, Copenhagen, Denmark), Balb/cJ mice (Taconic, Rensselaer, N.Y., USA; n=6 per group) were inoculated with single 0.5 mL intraperitoneal doses of $10^5$ CFU/mL ATCC 10211, and then randomized into treatment groups by animal identifier. All mice were female, age 6-8 weeks. The temperature and humidity were registered daily in the animal facilities. The temperature was 22° C.+/−2° C. and can be regulated by heating and cooling. The humidity was 55+/−10%. The air changes per hour were approximately 8-12 times (70-73 times per hours inside cages), and light/dark period was in 12-hours interval of 6 am-6 pm/6 pm-6 am. The mice had free access to domestic quality drinking water and food (Teklad Global diet 2916C, Envigo, Indianapolis, Ind., USA) and occasionally peanuts and sunflower seeds (Koge Korn A/S, Koge, Denmark). The mice were housed in IVC cages, 6-8 mice per cage, with bedding from Tapvei. Further, the animals were offered Enviro-Dri nesting material and cardboard houses (Bio-Serv, Flemington, N.J., USA).

Approximately 1 hour before inoculation, mice were treated orally with 45 µL Nurofen (30 mg/kg) as pain relief. Twenty-four hours prior to Hib inoculation, mice were intravenously administered 200 mg/kg IVIG+rHIG/rPIG mixture, 500 mg/kg IVIG+rHIG/rPIG mixture, 500 mg/kg IVIG (Gamunex; Grifols, S. A., Sant Cugat, Spain), or saline (no treatment). For the ciprofloxacin positive control, one hour after Hib inoculation, mice were dosed with 20 mg/kg ciprofloxacin. Mice were scored for clinical signs of infection, then after 6 hours all animals were sacrificed and blood and peritoneal fluid was collected for CFU determination by serial dilution and plating of 0.02 ml spots on chocolate agar plates.

rhATG was tested for ability to delay GVHD in immunodeficient NOD scid gamma (NSG) mice (genotype: NOD.Cg-Prkdc$^{scid}$ Il2rg$^{tm1Wjl}$/SzJ), compared against rabbit-ATG (Thymoglobulin; Sanofi Genzyme, Cambridge, Mass.) and a vehicle control. All mice were female, age 6-8 weeks. The mice were ear notched for identification and housed in individually ventilated polysulfonate cages with HEPA filtered air at a density of up to 5 mice per cage. The animal room was lighted entirely with artificial fluorescent lighting, with a controlled 12 hour light/dark cycle (6 am to 6 pm light). The normal temperature and relative humidity ranges in the animal rooms were 22-26° C. and 30-70%, respectively. The animal rooms were set to have up to 15 air exchanges per hour. Filtered tap water, acidified to a pH of 2.5 to 3.0, and standard rodent chow was provided ad libitum.

Each animal was grafted with approximately $1 \times 10^7$ PBMC of a single human donor. On Day 5 after PBMC engraftment, animals were randomized by weight and dosed intravenously every other day for two weeks with 5.5 mg/kg rhATG (n=8), 6.5 mg/kg Thymoglobulin (n=8), or a vehicle control (n=8), or Days 5, 6, and 7 post-engraftment with 5.5 mg/kg rhATG (n=8), 6.5 mg/kg Thymoglobulin (n=8), or a vehicle control (n=8). Two PBMC donors were tested for each dosing regimen (2 PBMC donors×2 dosing regimens×3 treatment groups×8 animals per group=96 animals). Animals were assessed for clinical signs of mortality daily. Mice were euthanized by CO2 asphyxiation before final study take down if they showed >20% weight loss from their starting weight or a combination of the following clinical signs: >10-20% weight loss from their starting weight, cold to touch, lethargic, pale, hunched posture and scruffy coat. 50 µL of blood was drawn from all alive animals on Days 9, 16, 23, and 30 post-engraftment via retro-orbital bleed, and flow cytometry stained for Human (hu)CD45-PE (clone HI30; BioLegend #304008, San Diego, Calif., USA) and 7AAD (BioLegend, San Diego, Calif., USA); 50 µL of CountBright beads (Thermo Fisher Scientific, Waltham, Mass., USA) were added to each sample prior to acquisition. Flow cytometric data acquisition was performed using the BD Biosciences FACSCanto flow cytometer (San Jose, Calif., USA), and data were acquired and analyzed using BD Biosciences FACSDiva™ software (version 8; San Jose, Calif., USA); lymphocytes, singlet, live cells, and CD45+ cells were gated and cell numbers quantified relative to CountBright beads. The gating strategy is outlined in FIG. 50B.

9. INCORPORATION BY REFERENCE

All publications, patents, patent applications and other documents cited in this application are hereby incorporated by reference in their entireties for all purposes to the same extent as if each individual publication, patent, patent application or other document were individually indicated to be incorporated by reference for all purposes.

10. EQUIVALENTS

Whereas various specific embodiments have been illustrated and described, the above specification is not restrictive. It will be appreciated that various changes can be made without departing from the spirit and scope of the invention(s). Many variations will become apparent to those skilled in the art upon review of this specification.

TABLE 6

Characteristics of the 50 donors screened to create rCIG libraries.

| GigaGen donor ID | Race | Sex | Age | Symptoms | Date of symptoms onset | Days between symptoms onset and blood draw | Presumed/ Confirmed | CoV-2 S1 binding EC50 (mg/ml) | CoV-2 S1 peak OD signal | CoV-2 RBD binding EC50 (mg/ml) | CoV-2 RBD peak OD signal | Library ID |
|---|---|---|---|---|---|---|---|---|---|---|---|---|
| CSS-1902 | AA | Male | 67 | Fever, SOB | Feb. 28, 2020 | 32 | Confirmed | 0.0056 | 3.15 | 0.039 | 2.46 | Library 1 |
| CSS-1905 | White | Male | 71 | Fever, Cough, SOB | Mar. 16, 2020 | 15 | Presumed | 0.019 | 3.22 | 0.12 | 2.34 | Library 1 |
| CSS-1907 | AA | Female | 66 | Fever, Cough | Mar. 14, 2020 | 17 | Presumed | 0.063 | 2.98 | 0.091 | 1.41 | Library 2 |
| CSS-1911 | White | Female | 61 | Fever, ST, SOB | Mar. 9, 2020 | 22 | Presumed | 0.10 | 2.80 | 0.13 | 0.75 | Library 2 |
| CSS-1921 | White | Female | 30 | Fever. ST, Cough, SOB | Mar. 17, 2020 | 15 | Confirmed | 0.021 | 2.95 | 0.11 | 1.81 | Library 3 |
| CSS-1920 | White | Female | 57 | Fever, Cough, SOB | Mar. 16, 2020 | 16 | Confirmed | 0.022 | 2.81 | 0.066 | 1.52 | Library 3 |
| CSS-1928 | White | Female | 63 | Fever, Cough | Mar. 14, 2020 | 19 | Presumed | 0.025 | 2.95 | 0.076 | 1.96 | Library 4 |
| CSS-1924 | White | Female | 31 | Fever, Cough, SOB | Mar. 21, 2020 | 12 | Confirmed | 0.16 | 2.63 | 0.23 | 2.30 | Library 4 |
| CSS-1944 | White | Female | 49 | Fever, ST, Cough, Pneumonia | Mar. 15, 2020 | 24 | Confirmed | 0.014 | 3.21 | 0.053 | 2.17 | Library 5 |
| CSS-1943 | White | Female | 52 | ST, Cough, SOB | Mar. 16, 2020 | 23 | Confirmed | 0.014 | 3.15 | 0.067 | 1.85 | Library 5 |
| CSS-1937 | White | Female | 35 | Fever, ST, Cough, SOB | Mar. 17, 2020 | 21 | Confirmed | 0.009 | 3.17 | 0.027 | 1.71 | Library 6 |
| CSS-1936 | White | Female | 23 | Fever, Cough, SOB | Mar. 7, 2020 | 31 | Confirmed | 0.011 | 3.16 | 0.088 | 2.01 | Library 6 |
| CSS-1901 | White | Male | 67 | Fever, Cough | Mar. 15, 2020 | 16 | Confirmed | 0.010 | 3.09 | 0.085 | 2.37 | Library 7 |
| CSS-1940 | White | Female | 40 | Fever, Cough | Mar. 18, 2020 | 21 | Confirmed | 0.012 | 3.07 | 0.057 | 1.99 | Library 7 |
| CSS-1939 | White | Female | 24 | Fever, ST, Cough, SOB | Mar. 8, 2020 | 30 | Confirmed | 0.037 | 3.10 | 0.073 | 1.37 | Library 8 |
| CSS-1949 | White | Male | 47 | Fever, Cough | Mar. 21, 2020 | 19 | Confirmed | 0.13 | 2.79 | 0.32 | 2.32 | Library 8 |
| CSS-1945 | White | Female | 31 | Fever, ST, Cough, SOB | Mar. 20, 2020 | 19 | Confirmed | 0.051 | 3.09 | 0.15 | 1.03 | |
| CSS-1931 | White | Female | 35 | Fever, ST, Cough, SOB | Mar. 24, 2020 | 13 | Confirmed | 0.11 | 2.45 | 0.27 | 1.22 | |
| CSS-1933 | White | Female | 43 | Fever, Cough | Feb. 25, 2020 | 42 | Confirmed | 0.13 | 3.23 | 0.27 | 1.16 | |
| CSS-1932 | White | Female | 33 | Fever, SOB | Mar. 18, 2020 | 20 | Confirmed | 0.13 | 3.09 | 0.11 | 1.05 | |
| CSS-1935 | White | Female | 45 | ST, Cough, SOB | Mar. 22, 2020 | 16 | Confirmed | 0.16 | 3.07 | 0.14 | 1.22 | |
| CSS-1948 | White | Female | 45 | Fever, Cough, SOB | Mar. 25, 2020 | 15 | Confirmed | 0.17 | 2.64 | 0.091 | 0.97 | |
| CSS-1938 | White | Female | 37 | Fever, ST, Cough, SOB | Mar. 22, 2020 | 16 | Confirmed | 0.20 | 3.20 | 0.25 | 0.82 | |
| CSS-1929 | AA | Male | 49 | Fever, Cough, SOB | Feb. 28, 2020 | 34 | Presumed | 0.23 | 0.92 | 0.041 | 1.31 | |
| CSS-1922 | White | Male | 54 | Fever, Cough, SOB | Feb. 28, 2020 | 34 | Presumed | 0.24 | 0.34 | 0.14 | 0.45 | |
| CSS-1914 | White | Female | 65 | Fever, Cough, SOB | Feb. 26, 2020 | 35 | Presumed | 0.37 | 1.54 | 0.39 | 2.76 | |
| CSS-1925 | White | Male | 63 | Fever, Cough, SOB, ST | Mar. 10, 2020 | 23 | Presumed | 0.65 | 0.68 | 0.17 | 0.75 | |
| CSS-1946 | White | Female | 50 | ST, Cough | Mar. 19, 2020 | 21 | Confirmed | 0.67 | 2.50 | 0.69 | 1.66 | |
| CSS-1930 | White | Female | 47 | Fever, Cough | Mar. 10, 2020 | 23 | Presumed | 0.69 | 0.45 | 1.29 | 0.94 | |
| CSS-1934 | White | Female | 42 | Fever, ST, Cough | Mar. 21, 2020 | 17 | Confirmed | 0.75 | 3.17 | 0.74 | 1.11 | |
| CSS-1926 | White | Female | 59 | Fever, Cough, SOB, ST | Mar. 8, 2020 | 25 | Presumed | 0.77 | 0.55 | 0.70 | 0.80 | |
| CSS-1915 | White | Male | 59 | Fever, ST, SOB | Mar. 11, 2020 | 21 | Presumed | 0.83 | 0.81 | 0.61 | 0.85 | |
| CSS-1941 | White | Female | 69 | ST, Cough | Mar. 11, 2020 | 28 | Confirmed | 0.91 | 2.93 | 0.55 | 0.94 | |
| CSS-1917 | White | Male | 67 | Fever, Cough | Mar. 10, 2020 | 22 | Presumed | 0.91 | 0.64 | 0.69 | 0.77 | |
| CSS-1904 | White | Female | 20 | Fever, ST, Cough | Mar. 11, 2020 | 20 | Confirmed | 0.96 | 0.64 | 0.63 | 0.86 | |
| CSS-1916 | White | Male | 70 | Fever, SOB | Feb. 27, 2020 | 34 | Presumed | 1.00 | 0.69 | 0.15 | 1.00 | |
| CSS-1947 | AA | Female | 52 | Fever, Cough | Mar. 21, 2020 | 19 | Confirmed | 1.25 | 2.68 | 0.81 | 0.99 | |
| CSS-1918 | White | Female | 59 | Fever, Cough, SOB | Mar. 2, 2020 | 30 | Presumed | 1.32 | 1.55 | 0.38 | 0.91 | |
| CSS-1923 | White | Female | 57 | Fever, Cough | Feb. 25, 2020 | 37 | Presumed | 1.33 | 0.62 | 0.92 | 1.35 | |
| CSS-1919 | White | Female | 53 | Fever, ST, SOB | Mar. 13, 2020 | 19 | Presumed | 1.34 | 0.80 | 0.30 | 0.76 | |
| CSS-1913 | White | Female | 57 | Fever, Cough | Mar. 5, 2020 | 26 | Presumed | 1.47 | 1.69 | 0.23 | 0.88 | |

TABLE 6-continued

Characteristics of the 50 donors screened to create rCIG libraries.

| GigaGen donor ID | Race | Sex | Age | Symptoms | Date of symptoms onset | Days between symptoms onset and blood draw | Presumed/ Confirmed | CoV-2 S1 binding EC50 (mg/ml) | CoV-2 S1 peak OD signal | CoV-2 RBD binding EC50 (mg/ml) | CoV-2 RBD peak OD signal | Library ID |
|---|---|---|---|---|---|---|---|---|---|---|---|---|
| CSS-1927 | AA | Female | 55 | Cough, ST | Mar. 2, 2020 | 31 | Presumed | 1.60 | 0.92 | 0.72 | 1.18 | |
| CSS-1909 | White | Female | 70 | Fever, Cough, SOB | Feb. 25, 2020 | 35 | Presumed | 1.88 | 0.92 | 0.13 | 0.75 | |
| CSS-1912 | White | Female | 46 | Fever, Cough, SOB | Mar. 8, 2020 | 23 | Confirmed | 2.20 | 0.76 | 0.10 | 0.67 | |
| CSS-1906 | White | Male | 58 | Fever, ST, SOB, Cough | Feb. 25, 2020 | 35 | Presumed | 2.59 | 1.28 | 1.46 | 1.31 | |
| CSS-1908 | White | Female | 57 | Fever, Cough, SOB | Feb. 24, 2020 | 36 | Presumed | 2.60 | 0.82 | 0.46 | 0.72 | |
| CSS-1910 | White | Female | 25 | Fever, ST, Cough, SOB | Mar. 4, 2020 | 27 | Presumed | 2.84 | 1.27 | 1.12 | 1.23 | |
| CSS-1942 | White | Female | 39 | Fever, Cough | Mar. 24, 2020 | 15 | Confirmed | 2.89 | 2.03 | 1.88 | 2.31 | |
| CSS-1903 | White | Female | 52 | Fever, Cough, SOB, Fatigue | Mar. 1, 2020 | 30 | Presumed | 3.47 | 0.84 | 1.25 | 0.99 | |
| CSS-1900 | White | Female | 69 | Fever, Cough | Mar. 6, 2020 | 25 | Presumed | 9.94 | 0.73 | 3.11 | 1.00 | |
| IVIG (Gamunex) | — | — | — | — | — | — | — | 1.41 | 1.99 | 1.27 | 2.26 | |

SOB = shortness of breath;
ST = sore throat.

TABLE 7

Characterization of the rCIG scFv sorted libraries. Library IDs are from TABLE S1. Each library plasma is a 1:1 mixture of plasma from the two donors who were used to generate each respective rCIG library. The % binders is determined by yeast scFv flow cytometry. The number of post-sort antibodies was determined by antibody RNA-seq using Illumina sequencing after the 2nd yeast sort.

| Library/ Sample | # input cells | # Ab clones (pre-sort; unique CDR3) | # Ab clones (post-sort; unique CDR3) | # Ab clones (pre-sort; combined CDR3) | # Ab clones (post-sort; combined CDR3) | Shannon entropy (pre-sort) |
|---|---|---|---|---|---|---|
| Sorted Library 1 | 3,400,000 | 87,902 | 3,971 | 41,306 | 1,472 | 5.6 |
| Library 1 plasma | — | — | — | — | — | — |
| Sorted Library 2 | 3,580,000 | 54,986 | 1,730 | 28,058 | 616 | 5.1 |
| Library 2 plasma | — | — | — | — | — | — |
| Sorted Library 3 | 3,490,000 | 67,805 | 3,042 | 31,374 | 1,013 | 6.2 |
| Library 3 plasma | — | — | — | — | — | — |
| Sorted Library 4 | 3,230,000 | 74,074 | 3,069 | 37,640 | 1,144 | 6.7 |
| Library 4 plasma | — | — | — | — | — | — |
| Sorted Library 5 | 3,790,000 | 156,592 | 2,122 | 89,406 | 1,062 | 6.9 |
| Library 5 plasma | — | — | — | — | — | — |
| Sorted Library 6 | 3,900,000 | 62,368 | 1,656 | 27,198 | 665 | 5.3 |
| Library 6 plasma | — | — | — | — | — | — |
| Sorted Library 7 | 2,950,000 | 67,212 | 1,768 | 24,004 | 662 | 5.8 |
| Library 7 plasma | — | — | — | — | — | — |
| Sorted Library 8 | 3,880,000 | 116,642 | 1,214 | 53,885 | 536 | 6.1 |
| Library 8 plasma | — | — | — | — | — | — |

TABLE 7-continued

Characterization of the rCIG scFv sorted libraries. Library IDs are from TABLE S1.
Each library plasma is a 1:1 mixture of plasma from the two donors who were used to
generate each respective rCIG library. The % binders
is determined by yeast scFv flow cytometry. The
number of post-sort antibodies was determined by
antibody RNA-seq using Illumina sequencing after the 2nd yeast sort.

| Library/Sample | | | | | |
|---|---|---|---|---|---|
| IVIG (Gamunex) | — | — | — | — | — |
| SARS CoV mAb [CR3022] | — | — | — | — | — |
| SARS CoV-2 mAb [SAD-S35] | — | — | — | — | — |

| Library/Sample | Shannon entropy (post-sort) | Simpson index (pre-sort) | Simpson index (post-sort) | # sequencing reads (pre-sort) | # sequencing reads (post-sort) |
|---|---|---|---|---|---|
| Sorted Library 1 | 2.6 | 0.99 | 0.86 | 674,234 | 58,556 |
| Library 1 plasma | — | — | — | — | — |
| Sorted Library 2 | 1.5 | 0.99 | 0.53 | 594,209 | 64,730 |
| Library 2 plasma | — | — | — | — | |
| Sorted Library 3 | 2.4 | 0.99 | 0.87 | 612,720 | 67,669 |
| Library 3 plasma | — | — | — | — | |
| Sorted Library 4 | 2.8 | 0.99 | 0.89 | 708,240 | 76,274 |
| Library 4 plasma | — | — | — | — | — |
| Sorted Library 5 | 2.6 | 0.99 | 0.77 | 717,789 | 34,397 |
| Library 5 plasma | — | — | — | — | — |
| Sorted Library 6 | 2.5 | 0.98 | 0.87 | 765,707 | 25,234 |
| Library 6 plasma | — | — | — | — | — |
| Sorted Library 7 | 2.0 | 0.99 | 0.78 | 846,270 | 34,556 |
| Library 7 plasma | — | — | — | — | — |
| Sorted Library 8 | 1.4 | 0.99 | 0.55 | 783,140 | 30,044 |
| Library 8 plasma | — | — | — | — | — |
| IVIG (Gamunex) | — | — | — | — | — |
| SARS CoV mAb [CR3022] | — | — | — | — | — |
| SARS CoV-2 mAb [SAD-S35] | — | — | — | — | — |

| Library/Sample | % binders (1st sort) | % binders (2nd sort) | % IgG subtype (pre-sort) | | | | % IgG subtype (post-sort) | | | |
|---|---|---|---|---|---|---|---|---|---|---|
| | | | IgG1 | IgG2 | IgG3 | IgG4 | IgG1 | IgG2 | IgG3 | IgG4 |
| Sorted Library 1 | 1.02 | 43.7 | 83.4 | 8.9 | 7.4 | 0.3 | 88.9 | 8.6 | 2.6 | 0.0 |
| Library 1 plasma | — | — | — | — | — | — | — | — | — | — |
| Sorted Library 2 | 0.57 | 35.8 | 61.1 | 21.4 | 16.2 | 1.3 | 63.6 | 28.8 | 3.0 | 4.6 |
| Library 2 plasma | — | — | — | — | — | — | — | — | — | — |
| Sorted Library 3 | 1.6 | 49.3 | 68.1 | 14.1 | 17.4 | 0.4 | 83.9 | 14.4 | 1.7 | 0.0 |

TABLE 7-continued

Characterization of the rCIG scFv sorted libraries. Library IDs are from TABLE S1.
Each library plasma is a 1:1 mixture of plasma from the two donors who were used to
generate each respective rCIG library. The % binders
is determined by yeast scFv flow cytometry. The
number of post-sort antibodies was determined by
antibody RNA-seq using Illumina sequencing after the 2nd yeast sort.

| Library/Sample | | | | | | | | | | |
|---|---|---|---|---|---|---|---|---|---|---|
| Library 3 plasma | — | — | — | — | — | — | — | — | — | — |
| Sorted Library 4 | 0.42 | 27.4 | 55.4 | 9.9 | 33.5 | 1.3 | 72.3 | 18.1 | 9.0 | 0.6 |
| Library 4 plasma | — | — | — | — | — | — | — | — | — | — |
| Sorted Library 5 | 2.29 | 47.8 | 54.7 | 22.0 | 22.8 | 0.6 | 80.8 | 14.1 | 5.1 | 0.0 |
| Library 5 plasma | — | — | — | — | — | — | — | — | — | — |
| Sorted Library 6 | 0.95 | 26.6 | 64.2 | 16.6 | 17.8 | 1.3 | 85.1 | 13.4 | 1.5 | 0.0 |
| Library 6 plasma | — | — | — | — | — | — | — | — | — | — |
| Sorted Library 7 | 1.37 | 34.7 | 74.2 | 15.5 | 10.0 | 0.3 | 92.2 | 5.2 | 2.6 | 0.0 |
| Library 7 plasma | — | — | — | — | — | — | — | — | — | — |
| Sorted Library 8 | 0.88 | 24.9 | 51.5 | 19.0 | 26.5 | 3.0 | 75.9 | 16.7 | 5.6 | 1.9 |
| Library 8 plasma | — | — | — | — | — | — | — | — | — | — |
| IVIG (Gamunex) | — | — | — | — | — | — | — | — | — | — |
| SARS CoV mAb [CR3022] | — | — | — | — | — | — | — | — | — | — |
| SARS CoV-2 mAb [SAD-535] | — | — | — | — | — | — | — | — | — | — |

| Library/Sample | CoV-2 S1 binding EC50 (mg/ml) | CoV-2 S1 binding fold over plasma avg | CoV-2 RBD binding EC50 (mg/ml) | CoV-2 RBD binding fold over plasma avg |
|---|---|---|---|---|
| Sorted Library 1 | 0.000072 | 335 | 0.000053 | 447 |
| Library 1 plasma | 0.013 | 1.9 | 0.013 | 1.8 |
| Sorted Library 2 | 0.00014 | 172 | 0.0001 | 237 |
| Library 2 plasma | 0.069 | 0.3 | 0.044 | 0.5 |
| Sorted Library 3 | 0.000052 | 464 | 0.000047 | 504 |
| Library 3 plasma | 0.024 | 1.0 | 0.034 | 0.7 |
| Sorted Library 4 | 0.000054 | 447 | 0.000058 | 409 |
| Library 4 plasma | 0.027 | 0.9 | 0.035 | 0.7 |
| Sorted Library 5 | 0.000066 | 366 | 0.000061 | 389 |
| Library 5 plasma | 0.017 | 1.4 | 0.021 | 1.1 |
| Sorted Library 6 | 0.000049 | 492 | 0.000054 | 439 |
| Library 6 plasma | 0.012 | 2.0 | 0.017 | 1.4 |
| Sorted Library 7 | 0.000042 | 574 | 0.000044 | 539 |
| Library 7 plasma | 0.012 | 2.0 | 0.0096 | 2.5 |
| Sorted Library 8 | 0.000028 | 862 | 0.000027 | 878 |
| Library 8 plasma | 0.019 | 1.3 | 0.016 | 1.5 |
| IVIG (Gamunex) | 1.38 | — | 1.25 | — |
| SARS CoV mAb [CR3022] |

TABLE 7-continued

Characterization of the rCIG scFv sorted libraries. Library IDs are from TABLE S1. Each library plasma is a 1:1 mixture of plasma from the two donors who were used to generate each respective rCIG library. The % binders is determined by yeast scFv flow cytometry. The number of post-sort antibodies was determined by antibody RNA-seq using Illumina sequencing after the 2nd yeast sort.

| | | | | |
|---|---|---|---|---|
| SARS CoV-2 mAb [SAD-535] | 0.000058 | — | 0.000057 | — |

| Library/Sample | Spike:ACE2 plate-based neutralization IC50 (mg/ml) | Spike:ACE2 plate-based neutralization over plasma avg | CoV-2 pseudotype neutralization IC50 (mg/ml) |
|---|---|---|---|
| Sorted Library 1 | 0.0026 | 288 | 0.00049 |
| Library 1 plasma | 0.7 | 1.1 | 0.015 |
| Sorted Library 2 | 0.0052 | 144 | 0.0048 |
| Library 2 plasma | 1.28 | 0.6 | 0.76 |
| Sorted Library 3 | 0.0018 | 416 | 0.0018 |
| Library 3 plasma | 0.28 | 2.7 | 0.056 |
| Sorted Library 4 | 0.0017 | 440 | 0.002 |
| Library 4 plasma | 2.4 | 0.3 | 0.031 |
| Sorted Library 5 | 0.0016 | 468 | 0.00082 |
| Library 5 plasma | 0.28 | 2.7 | 0.049 |
| Sorted Library 6 | 0.0016 | 468 | 0.00034 |
| Library 6 plasma | 0.38 | 2.0 | 0.039 |
| Sorted Library 7 | 0.023 | 33 | 0.00032 |
| Library 7 plasma | 0.32 | 2.3 | 0.024 |
| Sorted Library 8 | 0.0016 | 468 | 0.00017 |
| Library 8 plasma | 0.35 | 2.1 | 0.061 |
| IVIG (Gamunex) | None | — | None |
| SARS CoV mAb [CR3022] | None | — | 0.1 |
| SARS CoV-2 mAb [SAD-535] | 0.0011 | — | 0.00026 |

| Library/Sample | CoV-2 pseudotype neutralization over plasma avg | Live CoV-2 virus neutralization concentration (mg/ml) | Live CoV-2 virus neutralization over plasma avg |
|---|---|---|---|
| Sorted Library 1 | 264 | 0.0032 | 17 |
| Library 1 plasma | 8.6 | 0.016 | 3.3 |
| Sorted Library 2 | 27 | 0.0032 | 17 |
| Library 2 plasma | 0.2 | 0.166 | 0.3 |
| Sorted Library 3 | 72 | 0.0047 | 11 |
| Library 3 plasma | 2.3 | 0.032 | 1.7 |
| Sorted Library 4 | 65 | 0.002 | 26 |
| Library 4 plasma | 4.2 | 0.038 | 1.4 |
| Sorted Library 5 | 158 | 0.0017 | 31 |
| Library 5 plasma | 2.6 | 0.042 | 1.3 |
| Sorted Library 6 | 381 | 0.00043 | 123 |
| Library 6 plasma | 3.3 | 0.045 | 1.2 |
| Sorted Library 7 | 404 | 0.00095 | 56 |
| Library 7 plasma | 5.4 | 0.018 | 2.9 |
| Sorted Library 8 | 761 | 0.00048 | 110 |
| Library 8 plasma | 2.1 | 0.066 | 0.8 |
| IVIG (Gamunex) | — | None | — |
| SARS CoV mAb [CR3022] | — | Not tested | — |
| SARS CoV-2 mAb [SAD-535] | — | Not tested | — |

TABLE 8

The relative ratio that each of the eight sorted rCIG libraries was mixed is indicated.

| Sample/Library | CoV-2 pseudotype neutralization IC50 (mg/ml) | CoV-2 pseudotype neutralization over plasma avg | Live CoV-2 virus neutralization concentration (mg/ml) | Live CoV-2 virus neutralization over plasma avg | # Ab clones (post-sort; unique CDR3) | Most abundant clone | Relative ratio pooled |
|---|---|---|---|---|---|---|---|
| Sorted Library 1 | 0.00049 | 264.0 | 0.0032 | 17 | 3,971 | 30% | 1.5 |
| Library 1 plasma | 0.015 | 8.6 | 0.016 | 3.3 | — | — | |
| Sorted Library 2 | 0.0048 | 27.0 | 0.0032 | 17 | 1,730 | 77% | 0.1 |
| Library 2 plasma | 0.76 | 0.2 | 0.166 | 0.3 | — | — | |
| Sorted Library 3 | 0.0018 | 71.9 | 0.0047 | 11 | 3,042 | 19% | 0.5 |
| Library 3 plasma | 0.056 | 2.3 | 0.032 | 1.7 | — | — | |
| Sorted Library 4 | 0.002 | 64.7 | 0.002 | 26 | 3,069 | 18% | 0.5 |
| Library 4 plasma | 0.031 | 4.2 | 0.038 | 1.4 | — | — | |
| Sorted Library 5 | 0.00082 | 157.8 | 0.0017 | 31 | 2,122 | 58% | 0.5 |
| Library 5 plasma | 0.049 | 2.6 | 0.042 | 1.3 | — | — | |
| Sorted Library 6 | 0.00034 | 380.5 | 0.00043 | 123 | 1,656 | 51% | 1.5 |
| Library 6 plasma | 0.039 | 3.3 | 0.045 | 1.2 | — | — | |
| Sorted Library 7 | 0.00032 | 404.3 | 0.00095 | 56 | 1,768 | 40% | 1.9 |
| Library 7 plasma | 0.024 | 5.4 | 0.018 | 2.9 | — | — | |
| Sorted Library 8 | 0.00017 | 761.0 | 0.00048 | 110 | 1,214 | 68% | 1.15 |
| Library 8 plasma | 0.061 | 2.1 | 0.066 | 0.8 | — | — | |

TABLE 9

Characteristics of the rCIG CHO cell library. The IgG isotype refers to what isotype the variable region was prior to conversion of the sequence to IgG1 for expression in CHO.

| Library/Sample | # Ab clones (unique CDR3) | # Ab clones (combined CDR3) | Shannon entropy | Simpson index | # sequencing reads | Jaccard overlap to scFv library | Morisita overlap to scFv library | % IgG isotype | | | |
|---|---|---|---|---|---|---|---|---|---|---|---|
| | | | | | | | | IgG1 | IgG2 | IgG3 | IgG4 |
| rCIG | 12,500 | 2,529 | 3.4 | 0.94 | 1,234,402 | 43% | 74% | 78.1 | 16.6 | 4.7 | 0.6 |
| IVIG (Gamunex) | — | — | — | — | — | — | — | — | — | — | — |
| SARS CoV mAb [CR3022] | — | — | — | — | — | — | — | — | — | — | — |
| SARS CoV-2 mAb [SAD-535] | — | — | — | — | — | — | — | — | — | — | — |

| Library/Sample | CoV-2 S1 binding EC50 (mg/ml) | CoV-2 RBD binding EC50 (mg/ml) | Spike:ACE2 plate-based neutralization IC50 (mg/ml) | CoV-2 pseudotype neutralization IC50 (mg/ml) | CoV-2 live virus neutralization concentration (mg/ml) | Antigen binding EC50 (mg/ml) | | | | | |
|---|---|---|---|---|---|---|---|---|---|---|---|
| | | | | | | CoV-2 S (R683A, R685) | CoV-2 RBD (N354D) | CoV-2 RBD (N354D D364Y) | CoV-2 RBD (V367F) | CoV-2 RBD (W436R) | CoV-2 S (D614G) |
| rCIG | 0.000092 | 0.0001 | 0.0022 | 0.00043 | 0.00041 | 0.00009 | 0.00007 | 0.00008 | 0.00007 | 0.00007 | 0.00005 |
| IVIG (Gamunex) | 1.38 | 1.25 | None | None | None | 2.84 | 1.24 | 1.32 | 1.13 | 1.24 | 1.33 |
| SARS CoV mAb [CR3022] | 0.000078 | 0.000088 | None | 0.1 | NT | NT | NT | NT | NT | NT | NT |
| SARS CoV-2 mAb [SAD-S35] | 0.000058 | 0.000057 | 0.0011 | 0.00026 | NT | 0.00005 | 0.00004 | 0.00005 | 0.00004 | 0.00004 | 0.00003 |

TABLE 9-continued

Characteristics of the rCIG CHO cell library. The IgG isotype refers to what isotype the variable region was prior to conversion of the sequence to IgG1 for expression in CHO.

| Library/Sample | Antigen binding EC50 (mg/ml) | | | | Endotoxin (EU/mg) | Monomer (Protein A) | Monomer (Polished) |
|---|---|---|---|---|---|---|---|
| | HCoV-229E S1 NB | HCoV-NL63 S1 NB | MERS CoV S1 NB | SARS CoV RBD 0.0006 | | | |
| rCIG | 0.096 | 0.14 | 1.33 | 1.28 | 0.12 | 78.5% | 98.3% |
| IVIG (Gamunex) | NT | NT | NT | NT | — | — | — |
| SARS CoV mAb [CR3022] | NB | NB | NB | NB | — | — | — |
| SARS CoV-2 mAb [SAD-S35] | | | | | — | — | — |

NB, no binding observed (expected to be similar to IVIG if a higher concentration could be tested).
NT, not tested

TABLE 10

Characterization of the rZIG scFv library.

| Library | # input cells | # Ab clones (unique CDR3) | # Ab clones (combined CDR3) | Shannon entropy | Simpson index | # sequencing reads |
|---|---|---|---|---|---|---|
| rZIG | 2,080,000 | 119,700 | 33,561 | 5.6 | 0.99 | 1,128,316 |

TABLE 11

Characteristics of the rZIG CHO cell libraries.

| Library/Sample | # Ab clones (unique CDR3) | # Ab clones (combined CDR3) | Shannon entropy | Simpson index | # sequencing reads | Jaccard overlap to scFv library | Morisita overlap to scFv library | Jaccard overlap between rZIG-IgG1 and rZIG-LALA | Morisita overlap between rZIG-IgG1 and rZIG-LALA |
|---|---|---|---|---|---|---|---|---|---|
| rZIG-IgG1 | 33,642 | 4,692 | 5.4 | 0.99 | 1,580,084 | 40% | 56% | 58% | 86% |
| rZIG-LALA | 26,708 | 3,674 | 5.2 | 0.97 | 1,500,424 | 35% | 37% | | |
| IVIG | — | — | — | — | — | — | — | — | — |
| Zika/Dengue + serum | — | — | — | — | — | — | — | — | — |
| Zika/Dengue + mAb | — | — | — | — | — | — | — | — | — |

| Library/Sample | Binding EC50 (µg/ml) | | | | | Neutralization IC50 (µg/ml) | | | | |
|---|---|---|---|---|---|---|---|---|---|---|
| | Zika | Dengue serotype 1 | Dengue serotype 2 | Dengue serotype 3 | Dengue serotype 4 | Zika | Dengue serotype 1 | Dengue serotype 2 | Dengue serotype 3 | Dengue serotype 4 |
| rZIG-IgG1 | 1.13 | 0.89 | 1.55 | 1.21 | 1.31 | 0.28 | 7.24 | 1.01 | 5.88 | 1.51 |
| rZIG-LALA | 1.77 | 1.46 | 2.60 | 1.79 | 2.61 | 0.33 | 21.5 | 0.39 | 3.86 | 2.58 |
| IVIG | None | None | None | None | None | None | 12.2 | None | None | None |
| Zika/Dengue + serum | 141.8 | 133.8 | 128.1 | 131.8 | 135.6 | 34.7 | 2.5 | 4.94 | 6.79 | 5.39 |
| Zika/Dengue + mAb | NT | NT | NT | NT | NT | 0.098 | 0.048 | 0.21 | 0.28 | 0.12 |

| Library/Sample | Endotoxin (EU/mg) | Monomer |
|---|---|---|
| rZIG-IgG1 | <0.04 | 97.8% |
| rZIG-LALA | <0.09 | 97% |
| IVIG | — | — |

TABLE 11-continued

Characteristics of the rZIG CHO cell libraries.

| | | | |
|---|---|---|---|
| Zika/Dengue+ serum | | — | — |
| Zika/Dengue+ mAb | | | |

NT, Not tested

TABLE 12

Characterization of the rHIG and rPIG scFv libraries.

| Library | # input cells | # Ab clones (unique CDR3) | # Ab clones (combined CDR3) | Shannon entropy | Simpson index | # sequencing reads |
|---|---|---|---|---|---|---|
| rHIG | 1,180,000 | 75,311 | 21,169 | 7.3 | 0.99 | 1,062,125 |
| rPIG | 4,240,000 | 85,497 | 38,252 | 4.5 | 0.98 | 799,462 |

TABLE 13

Characteristics of the rHIG CHO cell library.

| Library/Sample | # Ab clones (unique CDR3) | # Ab clones (combined CDR3) | Shannon entropy | Simpson index | # sequencing reads | Jaccard overlap to scFv library | Morisita overlap to scFv library | Hib binding EC50 (µg/ml) | SBA assay (lowest concentration where ≥50% inhibition was observed; µg/mL) ATCC 10211 strain | Eagan strain | Endotoxin (EU/mg) | Monomer |
|---|---|---|---|---|---|---|---|---|---|---|---|---|
| rHIG | 49,206 | 6,381 | 6.8 | 0.99 | 1,389,205 | 40% | 59% | 0.2 | 0.82 | 2.47 | 0.03 | 97.7% |
| IVIG (Gamunex) | — | — | — | — | — | — | — | 46.6 | None | None | — | — |

SBA, serum bactericidal assay

TABLE 14

Characteristics of the rPIG CHO cell library.

| Library/Sample | # Ab clones (unique CDR3) | # Ab clones (combined CDR3) | Shannon entropy | Simpson index | # sequencing reads | Jaccard overlap to scFv library | Morisita overlap to scFv library | Binding EC50 to pool of 23 pneumococcus serotypes (µg/ml) |
|---|---|---|---|---|---|---|---|---|
| rHIG | 17,938 | 3,178 | 4.4 | 0.97 | 1,450,945 | 41% | 77% | 0.055 |
| IVIG (Gamunex) | — | — | — | — | — | — | — | 4.7 |
| | | | | | | | Fold over IVIG: | 85 |

| Library/Sample | Concentration of pneumococcus serotype-specific antibodies (µg/mg) | | | | | | | |
|---|---|---|---|---|---|---|---|---|
| | 1 | 3 | 4 | 5 | 6A | 6B | 7F | 9V |
| rPIG | 21.7 | 6.6 | 0.4 | 2.2 | none | 0.2 | none | 5.0 |
| IVIG (Gamunex) | 0.11 | 0.05 | 0.05 | 0.11 | 0.15 | 0.13 | 0.11 | 0.13 |
| | 203 | 140 | 6.98 | 20.1 | — | 1.72 | — | 39.4 |

TABLE 14-continued

Characteristics of the rPIG CHO cell library.

| Library/ | Concentration of pneumococcus serotype-specific antibodies (µg/mg) | | | | | | | |
|---|---|---|---|---|---|---|---|---|
| Sample | 12F | 14 | 18C | 19A | 19F | 22F | 23F | 33F |
| rPIG | 1.0 | 53.1 | 4.1 | 5.5 | 5.1 | 1.3 | 0.5 | 10.1 |
| IVIG (Gamunex) | 0.05 | 0.47 | 0.11 | 0.39 | 0.23 | 0.14 | 0.09 | 0.20 |
|  | 20.3 | 113 | 36 | 14 | 22.4 | 9.55 | 5.48 | 49.9 |

| Library/ | Pneumococcus serotype-specific opsonophagocytosis index | | | | | | | |
|---|---|---|---|---|---|---|---|---|
| Sample | 1 | 3 | 4 | 5 | 6A | 6B | 7F | 9V |
| rPIG | 8 | 277 | 76 | 61 | 17 | 15 | 189 | 56 |
| IVIG (Gamunex) | 8 | 8 | 11 | 8 | 26 | 15 | 47 | 56 |
|  | 1 | 34.6 | 6.91 | 7.63 | 0.65 | 1 | 4.02 | 1 |

| Library/ | Pneumococcus serotype-specific opsonophagocytosis index | | | | | | | | Endotoxin | |
|---|---|---|---|---|---|---|---|---|---|---|
| Sample | 12F | 14 | 18C | 19A | 19F | 22F | 23F | 33F | (EU/mg) | Monomer |
| rPIG | 620 | 727 | 357 | 72 | 72 | 96 | 45 | 147 | 0.03 | 98.6% |
| IVIG (Gamunex) | 23 | 46 | 66 | 20 | 13 | 39 | 27 | 57 | — | — |
|  | 27 | 15.8 | 5.41 | 3.6 | 5.54 | 2.46 | 1.67 | 2.58 | | |

TABLE 15

Characteristics of the IVIG + rHIG/rPIG mixture.

| Library/Sample | Hib binding EC50 (µg/ml) | Binding EC50 to pool of 23 pneumococcus serotypes (µg/ml) |
|---|---|---|
| IVIG + rHIG/rPIG | 2.54 | 0.3 |
| IVIG (Gamunex) | 46.6 | 2.49 |
| Fold over IVIG: | 18.3 | 8.3 |

TABLE 16

Characterization of the rhATG scFv libraries.

| Library | # input cells | # Ab clones (unique CDR3) | # Ab clones (combined CDR3) | Shannon entropy | Simpson index | # sequencing reads |
|---|---|---|---|---|---|---|
| rhATG (T cells; bone marrow) | 150,000 | 13,314 | 2,211 | 2.9 | 0.90 | 807,164 |
| rhATG (T cells; lymph node) | 1,640,000 | 34,324 | 5,605 | 4.0 | 0.92 | 1,189,267 |
| rhATG (Thymocytes; lymph node) | 2,060,000 | 22,030 | 4,216 | 3.8 | 0.95 | 632,083 |
| rhATG (Thymocytes; spleen) | 1,730,000 | 32,604 | 7,327 | 4.3 | 0.96 | 923,203 |

SEQUENCE LISTING (8434 sequences)

SEQ ID NO: 1 - protein, 10 aa, Homo sapiens
  Light chain CDR3 for antibody 1 (IGKV1-9)
QQVNSYPGPT

SEQ ID NO: 2 - protein, 12 aa, Homo sapiens
  Heavy chain CDR3 for antibody 1 (IGHV3-66)
ARDLSAAGGFDY

SEQ ID NO: 3 - protein, 8 aa, Homo sapiens
  Light chain CDR3 for antibody 2 (IGKV3-11)
QQRSNWFT

SEQ ID NO: 4 - protein, 17 aa, Homo sapiens
  Heavy chain CDR3 for antibody 2 (IGHV1-2)
ARAGAAGTPYYYYYMDV

SEQ ID NO: 5 - protein, 9 aa, Homo sapiens
  Light chain CDR3 for antibody 3 (IGKV1-6)
LQDYNYPWT

SEQ ID NO: 6 - protein, 18 aa, Homo sapiens
  Heavy chain CDR3 for antibody 3 (IGHV2-5)
AHYSGYSYGYPRAYGMDV

SEQ ID NO: 7 - protein, 8 aa, Homo sapiens
  Light chain CDR3 for antibody 4 (IGKV2D-28)
MQALQTPT

SEQ ID NO: 8 - protein, 17 aa, Homo sapiens
  Heavy chain CDR3 for antibody 4 (IGHV1-69)
ARGLLWFGADYYYGMDV

SEQ ID NO: 9 - protein, 9 aa, Homo sapiens
  Light chain CDR3 for antibody 5 (IGKV1-9)
QQLNSYPVA

SEQ ID NO: 10 - protein, 10 aa, Homo sapiens
  Heavy chain CDR3 for antibody 5 (IGHV3-66)
ARDLRSYYDY

SEQ ID NO: 11 - protein, 10 aa, Homo sapiens [sequence omitted]

SEQ ID NO: 12 - protein, 17 aa, Homo sapiens
  Heavy chain CDR3 for antibody 6 (IGHV1-2)
AREPSISRDGYSGYDDY

SEQ ID NO: 13 - protein, 11 aa, Homo sapiens
  Light chain CDR3 for antibody 7 (IGKV1-12)
QQANSFPPLFT

SEQ ID NO: 14 - protein, 12 aa, Homo sapiens
  Heavy chain CDR3 for antibody 7 (IGHV3-66)
ARDLEEQGAFDI

SEQ ID NO: 15 - protein, 9 aa, Homo sapiens
  Light chain CDR3 for antibody 8 (IGKV1-12)
QQANSFPYS

SEQ ID NO: 16 - protein, 11 aa, Homo sapiens
  Heavy chain CDR3 for antibody 8 (IGHV3-66)
ARETMVYGMDV

SEQ ID NO: 17 - protein, 10 aa, Homo sapiens
  Light chain CDR3 for antibody 9 (IGKV1-9)
QQLDTYPGPT

SEQ ID NO: 18 - protein, 12 aa, Homo sapiens
  Heavy chain CDR3 for antibody 9 (IGHV3-66)
ARDLSAAGGFDY

SEQ ID NO: 19 - protein, 9 aa, Homo sapiens
  Light chain CDR3 for antibody 10 (IGKV1-9)
QQLNSYSYT

SEQ ID NO: 20 - protein, 9 aa, Homo sapiens
  Heavy chain CDR3 for antibody 10 (IGHV3-53)
ARESYGMDV

SEQ ID NO: 21 - protein, 9 aa, Homo sapiens
  Light chain CDR3 for antibody 11 (IGKV3-20)
QQYGSSLYT

SEQ ID NO: 22 - protein, 16 aa, Homo sapiens
  Heavy chain CDR3 for antibody 11 (IGHV1-18)
ARANPGAVGYYYGMDV

SEQ ID NO: 23 - protein, 10 aa, Homo sapiens [sequence omitted]

SEQ ID NO: 24 - protein, 17 aa, Homo sapiens
  Heavy chain CDR3 for antibody 12 (IGHV1-69)
ARHSSDGDYYYYYGMDV

SEQ ID NO: 25 - protein, 9 aa, Homo sapiens
  Light chain CDR3 for antibody 13 (IGKV1-9)
QQLNSYPQT

SEQ ID NO: 26 - protein, 11 aa, Homo sapiens
  Heavy chain CDR3 for antibody 13 (IGHV3-53)
ARDLQVYGMDV

SEQ ID NO: 27 - protein, 9 aa, Homo sapiens
  Light chain CDR3 for antibody 14 (IGKV2D-28)
MQALQTPYT

SEQ ID NO: 28 - protein, 23 aa, Homo sapiens
  Heavy chain CDR3 for antibody 14 (IGHV1-2)
ARMPRPGWSPSWFGETDHRPLDY

SEQ ID NO: 29 - protein, 9 aa, Homo sapiens
  Light chain CDR3 for antibody 15 (IGKV1-9)
QQLNSYPPS

SEQ ID NO: 30 - protein, 22 aa, Homo sapiens
  Heavy chain CDR3 for antibody 15 (IGHV1-46)
AREGGLRVYDSSGYDTGYAFDI

SEQ ID NO: 31 - protein, 9 aa, Homo sapiens
  Light chain CDR3 for antibody 16 (IGKV1-17)
LQHNSYPRT

SEQ ID NO: 32 - protein, 16 aa, Homo sapiens
  Heavy chain CDR3 for antibody 16 (IGHV4-34)
ARGCSGGSCYPNPFDY

SEQ ID NO: 33 - protein, 9 aa, Homo sapiens
  Light chain CDR3 for antibody 17 (IGKV1-9)
QQLNSYPPP

SEQ ID NO: 34 - protein, 11 aa, Homo sapiens
  Heavy chain CDR3 for antibody 17 (IGHV3-53)
ARDLGPYGMDV

SEQ ID NO: 35 - protein, 9 aa, Homo sapiens
  Light chain CDR3 for antibody 18 (IGKV1-39)
QQSYSTPPT

SEQ ID NO: 36 - protein, 16 aa, Homo sapiens
  Heavy chain CDR3 for antibody 18 (IGHV3-33)
AREVDTAMDRTILWDY

SEQ ID NO: 37 - protein, 9 aa, Homo sapiens
  Light chain CDR3 for antibody 19 (IGKV1-9)
QQLNSYPVA

SEQ ID NO: 38 - protein, 12 aa, Homo sapiens
  Heavy chain CDR3 for antibody 19 (IGHV3-66)
ARDLSAAGGFDY

SEQ ID NO: 39 - protein, 10 aa, Homo sapiens
  Light chain CDR3 for antibody 20 (IGKV1-9)
QQVNSYPGPT

SEQ ID NO: 40 - protein, 10 aa, Homo sapiens
  Heavy chain CDR3 for antibody 20 (IGHV3-66)
ARDLRSYYDY

SEQ ID NO: 41 - protein, 10 aa, Homo sapiens
  Light chain CDR3 for antibody 21 (IGKV1-39)
QQSYSTPPLT

SEQ ID NO: 42 - protein, 20 aa, Homo sapiens
  Heavy chain CDR3 for antibody 21 (IGHV3-13)
ARVGYYYDSSGLKHYWYFDL

SEQ ID NO: 43 - protein, 9 aa, Homo sapiens
  Light chain CDR3 for antibody 22 (IGKV1-33)
QQYDNLPPT

SEQ ID NO: 44 - protein, 13 aa, Homo sapiens
  Heavy chain CDR3 for antibody 22 (IGHV4-31)
ARDYGGNANYFDY

SEQ ID NO: 45 - protein, 9 aa, Homo sapiens
  Light chain CDR3 for antibody 23 (IGKV1-39)
QQSYSTPPT

SEQ ID NO: 46 - protein, 19 aa, Homo sapiens
  Heavy chain CDR3 for antibody 23 (IGHV1-69)
ARAHRSSTSYRLGINWFDP

SEQ ID NO: 47 - protein, 9 aa, Homo sapiens
  Light chain CDR3 for antibody 24 (IGKV1-12)
QQANSFPPT

SEQ ID NO: 48 - protein, 17 aa, Homo sapiens
  Heavy chain CDR3 for antibody 24 (IGHV4/OR15-8)
ARDLTDYGDHGGYWFDP

SEQ ID NO: 49 - protein, 9 aa, Homo sapiens
  Light chain CDR3 for antibody 25 (IGKV1-33)
QQYDNLPLT

SEQ ID NO: 50 - protein, 13 aa, Homo sapiens
  Heavy chain CDR3 for antibody 25 (IGHV4-31)
ARDYGGNSAQFGY

SEQ ID NO: 51 - protein, 10 aa, Homo sapiens
  Light chain CDR3 for antibody 26 (IGKV1-33)
QQYDNLPSLT

SEQ ID NO: 52 - protein, 11 aa, Homo sapiens
  Heavy chain CDR3 for antibody 26 (IGHV3-66)
ARWAWTPIFDY

SEQ ID NO: 53 - protein, 10 aa, Homo sapiens
  Light chain CDR3 for antibody 27 (IGKV3-11)
QQRSNWPRAT

SEQ ID NO: 54 - protein, 18 aa, Homo sapiens
  Heavy chain CDR3 for antibody 27 (IGHV3-30)
AKDGSWYYDSSGYPVFDY

SEQ ID NO: 55 - protein, 9 aa, Homo sapiens
  Light chain CDR3 for antibody 28 (IGKV1-33)
QQYDNLPLT

SEQ ID NO: 56 - protein, 11 aa, Homo sapiens
  Heavy chain CDR3 for antibody 28 (IGHV3-53)
ARDGRGDLWSY

SEQ ID NO: 57 - protein, 10 aa, Homo sapiens
  Light chain CDR3 for antibody 29 (IGKV1-33)
QQYDNLPGVT

SEQ ID NO: 58 - protein, 20 aa, Homo sapiens
  Heavy chain CDR3 for antibody 29 (IGHV2-26)
ARTTYYYDSSGYYPLNYFDY

SEQ ID NO: 59 - protein, 9 aa, Homo sapiens
  Light chain CDR3 for antibody 30 (IGKV1-33)
QQYDNLPYS

SEQ ID NO: 60 - protein, 16 aa, Homo sapiens
  Heavy chain CDR3 for antibody 30 (IGHV4-61)
ARDGSYSSSWKNWFDP

SEQ ID NO: 61 - protein, 10 aa, Homo sapiens [sequence omitted]

SEQ ID NO: 62 - protein, 17 aa, Homo sapiens
  Heavy chain CDR3 for antibody 31 (IGHV1-2)
ARAGAAGTPYYYYYMDV

SEQ ID NO: 63 - protein, 9 aa, Homo sapiens
  Light chain CDR3 for antibody 32 (IGKV1-12)
QQANSFPFT

SEQ ID NO: 64 - protein, 17 aa, Homo sapiens
  Heavy chain CDR3 for antibody 32 (IGHV4-59)
ARSPRGWLEQQPGYFDY

SEQ ID NO: 65 - protein, 8 aa, Homo sapiens
  Light chain CDR3 for antibody 33 (IGKV3-11)
QQRSNWFT

SEQ ID NO: 66 - protein, 12 aa, Homo sapiens
  Heavy chain CDR3 for antibody 33 (IGHV3-66)
ARDLSAAGGFDY

SEQ ID NO: 67 - protein, 11 aa, Homo sapiens
  Light chain CDR3 for antibody 34 (IGKV1-12)
QQANSFPPLFT

SEQ ID NO: 68 - protein, 12 aa, Homo sapiens
  Heavy chain CDR3 for antibody 34 (IGHV3-66)
ARDLSAAGGFDY

SEQ ID NO: 69 - protein, 10 aa, Homo sapiens
  Light chain CDR3 for antibody 35 (IGKV1-9)
QQVNSYPGPT

SEQ ID NO: 70 - protein, 18 aa, Homo sapiens
  Heavy chain CDR3 for antibody 35 (IGHV2-5)
AHYSGYSYGYPRAYGMDV

SEQ ID NO: 71 - protein, 8 aa, Homo sapiens
  Light chain CDR3 for antibody 36 (IGKV3-11)
QQRSNWFT

SEQ ID NO: 72 - protein, 17 aa, Homo sapiens
  Heavy chain CDR3 for antibody 36 (IGHV1-2)
AREPSISRDGYSGYDDY

SEQ ID NO: 73 - protein, 10 aa, Homo sapiens
  Light chain CDR3 for antibody 37 (IGKV1-9)
QQVNSYPGPT

SEQ ID NO: 74 - protein, 17 aa, Homo sapiens
  Heavy chain CDR3 for antibody 37 (IGHV1-2)
ARAGAAGTPYYYYYMDV

SEQ ID NO: 75 - protein, 10 aa, Homo sapiens
  Light chain CDR3 for antibody 38 (IGKV1-39)
QQSYSTPPST

SEQ ID NO: 76 - protein, 14 aa, Homo sapiens
  Heavy chain CDR3 for antibody 38 (IGHV3-13)
ARGGGSSWYWYFDL

SEQ ID NO: 77 - protein, 10 aa, Homo sapiens
  Light chain CDR3 for antibody 39 (IGKV4-1)
QQYYSTPLYT

SEQ ID NO: 78 - protein, 17 aa, Homo sapiens
  Heavy chain CDR3 for antibody 39 (IGHV1-69)
ARGAEGIVVERGQPFDF

SEQ ID NO: 79 - protein, 8 aa, Homo sapiens
  Light chain CDR3 for antibody 40 (IGKV2D-28)
MQALQTPT

SEQ ID NO: 80 - protein, 17 aa, Homo sapiens
  Heavy chain CDR3 for antibody 40 (IGHV1-2)
ARAGAAGTPYYYYYMDV

SEQ ID NO: 81 - protein, 8 aa, Homo sapiens
  Light chain CDR3 for antibody 41 (IGKV2D-28)
MQALQTPT

SEQ ID NO: 82 - protein, 12 aa, Homo sapiens
  Heavy chain CDR3 for antibody 41 (IGHV3-66)
ARDLSAAGGFDY

SEQ ID NO: 83 - protein, 9 aa, Homo sapiens
  Light chain CDR3 for antibody 42 (IGKV1-6)
LQDYNYPWT

SEQ ID NO: 84 - protein, 12 aa, Homo sapiens
  Heavy chain CDR3 for antibody 42 (IGHV3-66)
ARDLSAAGGFDY

SEQ ID NO: 85 - protein, 10 aa, Homo sapiens
  Light chain CDR3 for antibody 43 (IGKV1-9)
QQLNSYPGPT

SEQ ID NO: 86 - protein, 12 aa, Homo sapiens
  Heavy chain CDR3 for antibody 43 (IGHV3-66)
ARDLSEAGGFDY

SEQ ID NO: 87 - protein, 11 aa, Homo sapiens
  Light chain CDR3 for antibody 44 (IGKV3-15)
QQYNNWPPMYT

SEQ ID NO: 88 - protein, 12 aa, Homo sapiens
  Heavy chain CDR3 for antibody 44 (IGHV3-53)
ARDLGSVGATDY

SEQ ID NO: 89 - protein, 9 aa, Homo sapiens
  Light chain CDR3 for antibody 45 (IGKV1-12)
QQANSFPYS

SEQ ID NO: 90 - protein, 12 aa, Homo sapiens
  Heavy chain CDR3 for antibody 45 (IGHV3-66)
ARDLSAAGGFDY

SEQ ID NO: 91 - protein, 10 aa, Homo sapiens
  Light chain CDR3 for antibody 46 (IGKV1-9)
QQVNSYPGPT

SEQ ID NO: 92 - protein, 12 aa, Homo sapiens
  Heavy chain CDR3 for antibody 46 (IGHV3-66)
ARDLEEQGAFDI

SEQ ID NO: 93 - protein, 9 aa, Homo sapiens
  Light chain CDR3 for antibody 47 (IGKV3-20)
QQYGSSPLT

SEQ ID NO: 94 - protein, 12 aa, Homo sapiens
  Heavy chain CDR3 for antibody 47 (IGHV3-66)
ARDLSEAGGFDY

SEQ ID NO: 95 - protein, 9 aa, Homo sapiens
  Light chain CDR3 for antibody 48 (IGKV3-20)
QQYASSPIT

SEQ ID NO: 96 - protein, 12 aa, Homo sapiens
  Heavy chain CDR3 for antibody 48 (IGHV3-66)
ARDLEEQGAFDI

SEQ ID NO: 97 - protein, 9 aa, Homo sapiens
  Light chain CDR3 for antibody 49 (IGKV1-33)
QQYDNLPPA

SEQ ID NO: 98 - protein, 20 aa, Homo sapiens
  Heavy chain CDR3 for antibody 49 (IGHV3-NL1)
AKQLGQYCSGGSCYSGYFDY

SEQ ID NO: 99 - protein, 10 aa, Homo sapiens
  Light chain CDR3 for antibody 50 (IGKV3-11)
QQRSNWPPFT

SEQ ID NO: 100 - protein, 15 aa, Homo sapiens
  Heavy chain CDR3 for antibody 50 (IGHV1-46)
ARDIVVVPAAMGLDY

SEQ ID NO: 101 - protein, 8 aa, Homo sapiens
  Light chain CDR3 for antibody 51 (IGKV3-11)
QQRSNWFT

SEQ ID NO: 102 - protein, 16 aa, Homo sapiens
  Heavy chain CDR3 for antibody 51 (IGHV1-2)
ARAGAAGTPYYYYMDV

SEQ ID NO: 103 - protein, 9 aa, Homo sapiens
  Light chain CDR3 for antibody 52 (IGKV3-20)
HQYVSSPHT

SEQ ID NO: 104 - protein, 12 aa, Homo sapiens
  Heavy chain CDR3 for antibody 52 (IGHV5-51)
ARQGYYGDYFDS

SEQ ID NO: 105 - protein, 10 aa, Homo sapiens
  Light chain CDR3 for antibody 53 (IGKV3-20)
QQYGSSPPYT

SEQ ID NO: 106 - protein, 12 aa, Homo sapiens
  Heavy chain CDR3 for antibody 53 (IGHV3-66)
ARDLSAAGGFDY

SEQ ID NO: 107 - protein, 9 aa, Homo sapiens
  Light chain CDR3 for antibody 54 (IGKV3-20)
QQYGSSPPT

SEQ ID NO: 108 - protein, 20 aa, Homo sapiens
  Heavy chain CDR3 for antibody 54 (IGHV1-2)
ASGTYYYDSSGYYWNDAFDI

SEQ ID NO: 109 - protein, 8 aa, Homo sapiens
  Light chain CDR3 for antibody 55 (IGKV3-11)
QQRSNWFT

SEQ ID NO: 110 - protein, 17 aa, Homo sapiens
  Heavy chain CDR3 for antibody 55 (IGHV1-69)
ARGLLWFGADYYYGMDV

SEQ ID NO: 111 - protein, 8 aa, Homo sapiens
  Light chain CDR3 for antibody 56 (IGKV3-11)
QQRSNWFT

SEQ ID NO: 112 - protein, 18 aa, Homo sapiens
  Heavy chain CDR3 for antibody 56 (IGHV2-5)
AHYSGYSYGYPRAYGMDV

SEQ ID NO: 113 - protein, 9 aa, Homo sapiens
  Light chain CDR3 for antibody 57 (IGKV3-20)
QQYGSSPLT

SEQ ID NO: 114 - protein, 20 aa, Homo sapiens
  Heavy chain CDR3 for antibody 57 (IGHV4-39)
ARTGHLIRFLEWLPINWFDP

SEQ ID NO: 115 - protein, 10 aa, Homo sapiens
  Light chain CDR3 for antibody 58 (IGKV1-33)
QQYDNLLLLT

SEQ ID NO: 116 - protein, 11 aa, Homo sapiens
  Heavy chain CDR3 for antibody 58 (IGHV4-31)
ARWSSSGSFDY

SEQ ID NO: 117 - protein, 9 aa, Homo sapiens
  Light chain CDR3 for antibody 59 (IGKV1-39)
QQSYSTPFT

SEQ ID NO: 118 - protein, 14 aa, Homo sapiens
  Heavy chain CDR3 for antibody 59 (IGHV1-69)
AKNEASALLAWFDP

SEQ ID NO: 119 - protein, 9 aa, Homo sapiens
  Light chain CDR3 for antibody 60 (IGKV3-20)
QQYGSSPLT

SEQ ID NO: 120 - protein, 16 aa, Homo sapiens
  Heavy chain CDR3 for antibody 60 (IGHV4/OR15-8)
ARYATAPIKQYNWFDP

SEQ ID NO: 121 - protein, 10 aa, Homo sapiens
  Light chain CDR3 for antibody 61 (IGKV1-9)
QQVNSYPGPT

SEQ ID NO: 122 - protein, 11 aa, Homo sapiens
  Heavy chain CDR3 for antibody 61 (IGHV3-66)
ARETMVYGMDV

SEQ ID NO: 123 - protein, 8 aa, Homo sapiens
  Light chain CDR3 for antibody 62 (IGKV1-NL1)
QQYYSTRT

SEQ ID NO: 124 - protein, 9 aa, Homo sapiens
  Heavy chain CDR3 for antibody 62 (IGHV4/OR15-8)
ARVLGAMFT

SEQ ID NO: 125 - protein, 9 aa, Homo sapiens
  Light chain CDR3 for antibody 63 (IGKV1-9)
QQLNSYPVA

SEQ ID NO: 126 - protein, 18 aa, Homo sapiens
  Heavy chain CDR3 for antibody 63 (IGHV2-5)
AHYSGYSYGYPRAYGMDV

SEQ ID NO: 127 - protein, 10 aa, Homo sapiens
  Light chain CDR3 for antibody 64 (IGKV1-33)
QQYDNLPPVT

SEQ ID NO: 128 - protein, 20 aa, Homo sapiens
  Heavy chain CDR3 for antibody 64 (IGHV6-1)
ARDQWGYCSGGSCYPVRFDP

SEQ ID NO: 129 - protein, 9 aa, Homo sapiens
  Light chain CDR3 for antibody 65 (IGKV1-9)
QQLNSYSYT

SEQ ID NO: 130 - protein, 12 aa, Homo sapiens
  Heavy chain CDR3 for antibody 65 (IGHV3-66)
ARDLSAAGGFDY

SEQ ID NO: 131 - protein, 9 aa, Homo sapiens
  Light chain CDR3 for antibody 66 (IGKV1-39)
QRTDSVPHS

SEQ ID NO: 132 - protein, 17 aa, Homo sapiens
  Heavy chain CDR3 for antibody 66 (IGHV2-70)
ARTHYDILTGHEAPFDY

SEQ ID NO: 133 - protein, 10 aa, Homo sapiens
  Light chain CDR3 for antibody 67 (IGKV1-9)
QQVNSYPGPT

SEQ ID NO: 134 - protein, 11 aa, Homo sapiens
  Heavy chain CDR3 for antibody 67 (IGHV3-53)
ARDLQVYGMDV

SEQ ID NO: 135 - protein, 9 aa, Homo sapiens
  Light chain CDR3 for antibody 68 (IGKV1-33)
QQYDNLPLT

SEQ ID NO: 136 - protein, 19 aa, Homo sapiens
  Heavy chain CDR3 for antibody 68 (IGHV4-61)
ARRRKYYYGSGSYYNAYDY

SEQ ID NO: 137 - protein, 9 aa, Homo sapiens
  Light chain CDR3 for antibody 69 (IGKV1-27)
QKYNSAPLT

SEQ ID NO: 138 - protein, 16 aa, Homo sapiens
  Heavy chain CDR3 for antibody 69 (IGHV1-69)
ARDHSGSYYYYYGMDV

SEQ ID NO: 139 - protein, 9 aa, Homo sapiens
  Light chain CDR3 for antibody 70 (IGKV1-39)
QQSHTFPLT

SEQ ID NO: 140 - protein, 20 aa, Homo sapiens
  Heavy chain CDR3 for antibody 70 (IGHV4-59)
ARTPTDYDFWSGTLRNWFDP

SEQ ID NO: 141 - protein, 10 aa, Homo sapiens
  Light chain CDR3 for antibody 71 (IGKV1-33)
QQYDNLPWRS

SEQ ID NO: 142 - protein, 17 aa, Homo sapiens
  Heavy chain CDR3 for antibody 71 (IGHV3-66)
ARDVYCSSTSCTDAFDI

SEQ ID NO: 143 - protein, 9 aa, Homo sapiens
  Light chain CDR3 for antibody 72 (IGKV2D-28)
MQALQTPYT

SEQ ID NO: 144 - protein, 17 aa, Homo sapiens
  Heavy chain CDR3 for antibody 72 (IGHV1-2)
ARAGAAGTPYYYYYMDV

SEQ ID NO: 145 - protein, 10 aa, Homo sapiens
  Light chain CDR3 for antibody 73 (IGKV1-9)
QQLNSYPSIT

SEQ ID NO: 146 - protein, 11 aa, Homo sapiens
  Heavy chain CDR3 for antibody 73 (IGHV3-53)
ARDKWEGAFDI

SEQ ID NO: 147 - protein, 10 aa, Homo sapiens [sequence omitted]

SEQ ID NO: 148 - protein, 12 aa, Homo sapiens
  Heavy chain CDR3 for antibody 74 (IGHV3-66)
ARDLSAAGGFDY

SEQ ID NO: 149 - protein, 8 aa, Homo sapiens
  Light chain CDR3 for antibody 75 (IGKV1-13)
QQFNSYPS

SEQ ID NO: 150 - protein, 20 aa, Homo sapiens
  Heavy chain CDR3 for antibody 75 (IGHV3-NL1)
AKDQGEYCSGGSCYSGTFDY

SEQ ID NO: 151 - protein, 9 aa, Homo sapiens
  Light chain CDR3 for antibody 76 (IGKV3D-20)
QQFGNSPWT

SEQ ID NO: 152 - protein, 9 aa, Homo sapiens
  Heavy chain CDR3 for antibody 76 (IGHV4-30-2)
TRGGHYTDP

SEQ ID NO: 153 - protein, 9 aa, Homo sapiens
  Light chain CDR3 for antibody 77 (IGKV1-33)
QQYDNLPLT

SEQ ID NO: 154 - protein, 12 aa, Homo sapiens
  Heavy chain CDR3 for antibody 77 (IGHV3-66)
ARDLSAAGGFDY

SEQ ID NO: 155 - protein, 9 aa, Homo sapiens
  Light chain CDR3 for antibody 78 (IGKV3-20)
QQYGSSPYT

SEQ ID NO: 156 - protein, 21 aa, Homo sapiens
  Heavy chain CDR3 for antibody 78 (IGHV4/OR15-8)
AREPTVYNWNDMEYYYYGMDV

SEQ ID NO: 157 - protein, 10 aa, Homo sapiens [sequence omitted]

SEQ ID NO: 158 - protein, 18 aa, Homo sapiens
  Heavy chain CDR3 for antibody 79 (IGHV2-5)
AHYSGYSYGYPRAYGMDV

SEQ ID NO: 159 - protein, 9 aa, Homo sapiens
  Light chain CDR3 for antibody 80 (IGKV3-20)
QQYGSSPLT

SEQ ID NO: 160 - protein, 9 aa, Homo sapiens
  Heavy chain CDR3 for antibody 80 (IGHV3-53)
ARESYGMDV

SEQ ID NO: 161 - protein, 9 aa, Homo sapiens
  Light chain CDR3 for antibody 81 (IGKV1-39)
QQSYSTPPT

SEQ ID NO: 162 - protein, 12 aa, Homo sapiens
  Heavy chain CDR3 for antibody 81 (IGHV3-66)
ARDLSAAGGFDY

SEQ ID NO: 163 - protein, 10 aa, Homo sapiens
  Light chain CDR3 for antibody 82 (IGKV1-27)
QKYNSAPRRT

SEQ ID NO: 164 - protein, 12 aa, Homo sapiens
  Heavy chain CDR3 for antibody 82 (IGHV4-59)
ARGAGRYSHLDY

SEQ ID NO: 165 - protein, 9 aa, Homo sapiens
  Light chain CDR3 for antibody 83 (IGKV2D-28)
MQALQTPPT

SEQ ID NO: 166 - protein, 18 aa, Homo sapiens
  Heavy chain CDR3 for antibody 83 (IGHV1-8)
ARGGVAVPGTGYYYGVDV

SEQ ID NO: 167 - protein, 9 aa, Homo sapiens
  Light chain CDR3 for antibody 84 (IGKV1-27)
QKYNSAPWT

SEQ ID NO: 168 - protein, 12 aa, Homo sapiens
  Heavy chain CDR3 for antibody 84 (IGHV2-70)
ARGVEYYYYMDV

SEQ ID NO: 169 - protein, 9 aa, Homo sapiens
  Light chain CDR3 for antibody 85 (IGKV1-9)
QQLNSYPVA

SEQ ID NO: 170 - protein, 17 aa, Homo sapiens
  Heavy chain CDR3 for antibody 85 (IGHV1-2)
ARAGAAGTPYYYYYMDV

SEQ ID NO: 171 - protein, 10 aa, Homo sapiens
  Light chain CDR3 for antibody 86 (IGKV1-9)
QQVNSYPGPT

SEQ ID NO: 172 - protein, 9 aa, Homo sapiens
  Heavy chain CDR3 for antibody 86 (IGHV3-53)
ARESYGMDV

SEQ ID NO: 173 - protein, 9 aa, Homo sapiens
  Light chain CDR3 for antibody 87 (IGKV3-20)
QQYGSSPLT

SEQ ID NO: 174 - protein, 16 aa, Homo sapiens
  Heavy chain CDR3 for antibody 87 (IGHV4-31)
ARAGITIFGVVTAFDY

SEQ ID NO: 175 - protein, 8 aa, Homo sapiens
  Light chain CDR3 for antibody 88 (IGKV2D-28)
MQALQTPT

SEQ ID NO: 176 - protein, 17 aa, Homo sapiens
  Heavy chain CDR3 for antibody 88 (IGHV1-2)
AREPSISRDGYSGYDDY

SEQ ID NO: 177 - protein, 10 aa, Homo sapiens
  Light chain CDR3 for antibody 89 (IGKV1-33)
QQYDNLPSLT

SEQ ID NO: 178 - protein, 12 aa, Homo sapiens
  Heavy chain CDR3 for antibody 89 (IGHV3-66)
ARDLSAAGGFDY

SEQ ID NO: 179 - protein, 9 aa, Homo sapiens
  Light chain CDR3 for antibody 90 (IGKV1-6)
LQDYNYPWT

SEQ ID NO: 180 - protein, 17 aa, Homo sapiens
  Heavy chain CDR3 for antibody 90 (IGHV1-2)
ARAGAAGTPYYYYYMDV

SEQ ID NO: 181 - protein, 8 aa, Homo sapiens
  Light chain CDR3 for antibody 91 (IGKV2D-28)
MQALQTPT

SEQ ID NO: 182 - protein, 18 aa, Homo sapiens
  Heavy chain CDR3 for antibody 91 (IGHV2-5)
AHYSGYSYGYPRAYGMDV

SEQ ID NO: 183 - protein, 9 aa, Homo sapiens
  Light chain CDR3 for antibody 92 (IGKV1-39)
QQSYSTPLT

SEQ ID NO: 184 - protein, 17 aa, Homo sapiens
  Heavy chain CDR3 for antibody 92 (IGHV4-59)
ARVSRRWLQLPDYHFDY

SEQ ID NO: 185 - protein, 8 aa, Homo sapiens
  Light chain CDR3 for antibody 93 (IGKV3-11)
QQRSNWFT

SEQ ID NO: 186 - protein, 10 aa, Homo sapiens
  Heavy chain CDR3 for antibody 93 (IGHV3-66)
ARDLRSYYDY

SEQ ID NO: 187 - protein, 11 aa, Homo sapiens
  Light chain CDR3 for antibody 94 (IGKV1-33)
QQYDNLPPLYS

SEQ ID NO: 188 - protein, 12 aa, Homo sapiens
  Heavy chain CDR3 for antibody 94 (IGHV1-69)
ARDYGDYVGAVN

SEQ ID NO: 189 - protein, 9 aa, Homo sapiens
  Light chain CDR3 for antibody 95 (IGKV3-20)
QQYASSPIT

SEQ ID NO: 190 - protein, 13 aa, Homo sapiens
  Heavy chain CDR3 for antibody 95 (IGHV3-21)
TGPTGGGWGGFSY

SEQ ID NO: 191 - protein, 9 aa, Homo sapiens
  Light chain CDR3 for antibody 96 (IGKV1-33)
QQYDNLPIT

SEQ ID NO: 192 - protein, 14 aa, Homo sapiens
  Heavy chain CDR3 for antibody 96 (IGHV3-23)
AKALAAAGYDAFDI

SEQ ID NO: 193 - protein, 9 aa, Homo sapiens
  Light chain CDR3 for antibody 97 (IGKV1-6)
LQDYNYPWT

SEQ ID NO: 194 - protein, 10 aa, Homo sapiens
  Heavy chain CDR3 for antibody 97 (IGHV3-66)
ARDLRSYYDY

SEQ ID NO: 195 - protein, 9 aa, Homo sapiens
  Light chain CDR3 for antibody 98 (IGKV1-39)
QQSHTFPLT

SEQ ID NO: 196 - protein, 17 aa, Homo sapiens
  Heavy chain CDR3 for antibody 98 (IGHV4/OR15-8)
ARDLTDYGDHGGYWFDP

SEQ ID NO: 197 - protein, 9 aa, Homo sapiens
  Light chain CDR3 for antibody 99 (IGKV2D-28)
MQALQTPYT

SEQ ID NO: 198 - protein, 17 aa, Homo sapiens
  Heavy chain CDR3 for antibody 99 (IGHV1-69)
ARGLLWFGADYYYGMDV

SEQ ID NO: 199 - protein, 10 aa, Homo sapiens [sequence omitted]

SEQ ID NO: 200 - protein, 17 aa, Homo sapiens
  Heavy chain CDR3 for antibody 100 (IGHV1-69)
ARGLLWFGADYYYGMDV

SEQ ID NO: 201 - protein, 8 aa, Homo sapiens
  Light chain CDR3 for antibody 101 (IGKV3-20)
QQYGSSRS

SEQ ID NO: 202 - protein, 12 aa, Homo sapiens
  Heavy chain CDR3 for antibody 101 (IGHV1-69)
ARWGDYYDSSDY

SEQ ID NO: 203 - protein, 9 aa, Homo sapiens
  Light chain CDR3 for antibody 102 (IGKV1-39)
QQSHTFPLT

SEQ ID NO: 204 - protein, 15 aa, Homo sapiens
  Heavy chain CDR3 for antibody 102 (IGHV1-18)
ARVKRSWGEDSFAAY

SEQ ID NO: 205 - protein, 9 aa, Homo sapiens
  Light chain CDR3 for antibody 103 (IGKV4-1)
QQYYSTPLT

SEQ ID NO: 206 - protein, 10 aa, Homo sapiens
  Heavy chain CDR3 for antibody 103 (IGHV4-31)
ARGGHYEYDY

SEQ ID NO: 207 - protein, 9 aa, Homo sapiens
  Light chain CDR3 for antibody 104 (IGKV3-20)
QQYGSSLYT

SEQ ID NO: 208 - protein, 17 aa, Homo sapiens
  Heavy chain CDR3 for antibody 104 (IGHV1-2)
ARAGAAGTPYYYYYMDV

SEQ ID NO: 209 - protein, 10 aa, Homo sapiens
  Light chain CDR3 for antibody 105 (IGKV1-39)
QQSYSTPPLT

SEQ ID NO: 210 - protein, 12 aa, Homo sapiens
  Heavy chain CDR3 for antibody 105 (IGHV3-66)
ARDLSAAGGFDY

SEQ ID NO: 211 - protein, 9 aa, Homo sapiens
  Light chain CDR3 for antibody 106 (IGKV1-17)
LQHNSYPRT

SEQ ID NO: 212 - protein, 15 aa, Homo sapiens
  Heavy chain CDR3 for antibody 106 (IGHV1-69)
ARTDWDGYNFSWFDP

SEQ ID NO: 213 - protein, 11 aa, Homo sapiens
  Light chain CDR3 for antibody 107 (IGKV1-12)
QQANSFPPLFT

SEQ ID NO: 214 - protein, 10 aa, Homo sapiens
  Heavy chain CDR3 for antibody 107 (IGHV3-66)
ARDLRSYYDY

SEQ ID NO: 215 - protein, 9 aa, Homo sapiens
  Light chain CDR3 for antibody 108 (IGKV1-39)
QQSHTFPLT

SEQ ID NO: 216 - protein, 12 aa, Homo sapiens
  Heavy chain CDR3 for antibody 108 (IGHV1-46)
ARAPSDFYGLDV

SEQ ID NO: 217 - protein, 9 aa, Homo sapiens
  Light chain CDR3 for antibody 109 (IGKV1-9)
QQLNSYPQT

SEQ ID NO: 218 - protein, 12 aa, Homo sapiens
  Heavy chain CDR3 for antibody 109 (IGHV3-66)
ARDLSEAGGFDY

SEQ ID NO: 219 - protein, 9 aa, Homo sapiens
  Light chain CDR3 for antibody 110 (IGKV3-20)
QQYGSSPLT

SEQ ID NO: 220 - protein, 12 aa, Homo sapiens
  Heavy chain CDR3 for antibody 110 (IGHV4-31)
ARDYGDYEGVVA

SEQ ID NO: 221 - protein, 10 aa, Homo sapiens
  Light chain CDR3 for antibody 111 (IGKV1-9)
QQVNSYPGPT

SEQ ID NO: 222 - protein, 17 aa, Homo sapiens
  Heavy chain CDR3 for antibody 111 (IGHV1-69)
ARGLLWFGADYYYGMDV

SEQ ID NO: 223 - protein, 8 aa, Homo sapiens
  Light chain CDR3 for antibody 112 (IGKV3-11)
QQRSNWFT

SEQ ID NO: 224 - protein, 22 aa, Homo sapiens
  Heavy chain CDR3 for antibody 112 (IGHV1-46)
AREGGLRVYDSSGYDTGYAFDI

SEQ ID NO: 225 - protein, 9 aa, Homo sapiens
  Light chain CDR3 for antibody 113 (IGKV1-27)
QKYNSALWT

SEQ ID NO: 226 - protein, 14 aa, Homo sapiens
  Heavy chain CDR3 for antibody 113 (IGHV3-h)
ARIDYYDSSGYPDY

SEQ ID NO: 227 - protein, 9 aa, Homo sapiens
  Light chain CDR3 for antibody 114 (IGKV1-9)
QQLNSYPVA

SEQ ID NO: 228 - protein, 11 aa, Homo sapiens
  Heavy chain CDR3 for antibody 114 (IGHV3-66)
ARETMVYGMDV

SEQ ID NO: 229 - protein, 9 aa, Homo sapiens
  Light chain CDR3 for antibody 115 (IGKV1-33)
QQYDNLPPT

SEQ ID NO: 230 - protein, 15 aa, Homo sapiens
  Heavy chain CDR3 for antibody 115 (IGHV3-30)
AKDIYLWSSGNYFDY

SEQ ID NO: 231 - protein, 10 aa, Homo sapiens
  Light chain CDR3 for antibody 116 (IGKV3-11)
QQRSNWPRAT

SEQ ID NO: 232 - protein, 12 aa, Homo sapiens
  Heavy chain CDR3 for antibody 116 (IGHV3-66)
ARDLSAAGGFDY

SEQ ID NO: 233 - protein, 9 aa, Homo sapiens
  Light chain CDR3 for antibody 117 (IGKV1-33)
QQYDNLPLT

SEQ ID NO: 234 - protein, 18 aa, Homo sapiens
  Heavy chain CDR3 for antibody 117 (IGHV2-5)
AHYSGYSYGYPRAYGMDV

SEQ ID NO: 235 - protein, 9 aa, Homo sapiens
  Light chain CDR3 for antibody 118 (IGKV1-39)
QQFNSYPLT

SEQ ID NO: 236 - protein, 17 aa, Homo sapiens
  Heavy chain CDR3 for antibody 118 (IGHV4-34)
ARGRFLEWLGTLDAFDI

SEQ ID NO: 237 - protein, 9 aa, Homo sapiens
  Light chain CDR3 for antibody 119 (IGKV4-1)
QQYYSTPLT

SEQ ID NO: 238 - protein, 17 aa, Homo sapiens
  Heavy chain CDR3 for antibody 119 (IGHV4/OR15-8)
ARDLTDYGDHGGYWFDP

SEQ ID NO: 239 - protein, 9 aa, Homo sapiens
  Light chain CDR3 for antibody 120 (IGKV1-9)
QQLNSYPVA

SEQ ID NO: 240 - protein, 12 aa, Homo sapiens
  Heavy chain CDR3 for antibody 120 (IGHV3-66)
ARDLEEQGAFDI

SEQ ID NO: 241 - protein, 9 aa, Homo sapiens
  Light chain CDR3 for antibody 121 (IGKV1-33)
QQYDNLPIT

SEQ ID NO: 242 - protein, 16 aa, Homo sapiens
  Heavy chain CDR3 for antibody 121 (IGHV3-30)
AKPLYSYGAPQTYFDY

SEQ ID NO: 243 - protein, 9 aa, Homo sapiens
  Light chain CDR3 for antibody 122 (IGKV1-12)
QQANGFPLT

SEQ ID NO: 244 - protein, 12 aa, Homo sapiens
  Heavy chain CDR3 for antibody 122 (IGHV2-5)
GYRGGARAWFGP

SEQ ID NO: 245 - protein, 9 aa, Homo sapiens
  Light chain CDR3 for antibody 123 (IGKV1-39)
QQSYSAPLA

SEQ ID NO: 246 - protein, 8 aa, Homo sapiens
  Heavy chain CDR3 for antibody 123 (IGHV1-8)
ARGRVADY

SEQ ID NO: 247 - protein, 9 aa, Homo sapiens
  Light chain CDR3 for antibody 124 (IGKV1-12)
QQANSFPYS

SEQ ID NO: 248 - protein, 10 aa, Homo sapiens
  Heavy chain CDR3 for antibody 124 (IGHV3-66)
ARDLRSYYDY

SEQ ID NO: 249 - protein, 9 aa, Homo sapiens
  Light chain CDR3 for antibody 125 (IGKV4-1)
QQYYSTPLT

SEQ ID NO: 250 - protein, 19 aa, Homo sapiens
  Heavy chain CDR3 for antibody 125 (IGHV4-31)
ARCTTTTQWLKMVVNWFDP

SEQ ID NO: 251 - protein, 8 aa, Homo sapiens
  Light chain CDR3 for antibody 126 (IGKV3-11)
QQRSNWFT

SEQ ID NO: 252 - protein, 23 aa, Homo sapiens
  Heavy chain CDR3 for antibody 126 (IGHV1-2)
ARMPRPGWSPSWFGETDHRPLDY

SEQ ID NO: 253 - protein, 9 aa, Homo sapiens
  Light chain CDR3 for antibody 127 (IGKV1-39)
QQSYSTPHT

SEQ ID NO: 254 - protein, 12 aa, Homo sapiens
  Heavy chain CDR3 for antibody 127 (IGHV1-69)
ARDYGDYEGVVA

SEQ ID NO: 255 - protein, 10 aa, Homo sapiens
  Light chain CDR3 for antibody 128 (IGKV1-9)
QQVNSYPGPT

SEQ ID NO: 256 - protein, 16 aa, Homo sapiens
  Heavy chain CDR3 for antibody 128 (IGHV3-33)
AREVDTAMDRTILWDY

SEQ ID NO: 257 - protein, 9 aa, Homo sapiens
  Light chain CDR3 for antibody 129 (IGKV1D-12)
QQANSFPLT

SEQ ID NO: 258 - protein, 17 aa, Homo sapiens
  Heavy chain CDR3 for antibody 129 (IGHV4-59)
ARAERGWLRRPEYYFDY

SEQ ID NO: 259 - protein, 10 aa, Homo sapiens
  Light chain CDR3 for antibody 130 (IGKV1-5)
QQYNSYATIT

SEQ ID NO: 260 - protein, 21 aa, Homo sapiens
  Heavy chain CDR3 for antibody 130 (IGHV4-61)
ARESGFHDVWTQWGYNYGMDV

SEQ ID NO: 261 - protein, 10 aa, Homo sapiens
  Light chain CDR3 for antibody 131 (IGKV1-9)
QQLDTYPGPT

SEQ ID NO: 262 - protein, 10 aa, Homo sapiens
  Heavy chain CDR3 for antibody 131 (IGHV3-66)
ARDLRSYYDY

SEQ ID NO: 263 - protein, 8 aa, Homo sapiens
  Light chain CDR3 for antibody 132 (IGKV2D-28)
MQALQTPT

SEQ ID NO: 264 - protein, 17 aa, Homo sapiens
  Heavy chain CDR3 for antibody 132 (IGHV1-69)
ARHSSDGDYYYYYGMDV

SEQ ID NO: 265 - protein, 9 aa, Homo sapiens
  Light chain CDR3 for antibody 133 (IGKV5-2)
LQHDNFPYT

SEQ ID NO: 266 - protein, 15 aa, Homo sapiens
  Heavy chain CDR3 for antibody 133 (IGHV1-2)
ANIMVPKPGSTAFDI

SEQ ID NO: 267 - protein, 10 aa, Homo sapiens
  Light chain CDR3 for antibody 134 (IGKV1-9)
QQLNSYPPFT

SEQ ID NO: 268 - protein, 11 aa, Homo sapiens
  Heavy chain CDR3 for antibody 134 (IGHV3-66)
ARETMVYGMDV

SEQ ID NO: 269 - protein, 10 aa, Homo sapiens
  Light chain CDR3 for antibody 135 (IGKV3-11)
QQRSNWPPYS

SEQ ID NO: 270 - protein, 12 aa, Homo sapiens
  Heavy chain CDR3 for antibody 135 (IGHV1-69)
ARDYGDYEGVVA

SEQ ID NO: 271 - protein, 9 aa, Homo sapiens
  Light chain CDR3 for antibody 136 (IGKV3-11)
QQRSNWPLT

SEQ ID NO: 272 - protein, 23 aa, Homo sapiens
  Heavy chain CDR3 for antibody 136 (IGHV1-8)
ARGVGSYYDFWSGWDYYYYYMDV

SEQ ID NO: 273 - protein, 9 aa, Homo sapiens
  Light chain CDR3 for antibody 137 (IGKV1-5)
QRYNSFPIT

SEQ ID NO: 274 - protein, 13 aa, Homo sapiens
  Heavy chain CDR3 for antibody 137 (IGHV3-11)
AAGGSTTSWYWRS

SEQ ID NO: 275 - protein, 9 aa, Homo sapiens
  Light chain CDR3 for antibody 138 (IGKV2D-30)
MQGTHWPPT

SEQ ID NO: 276 - protein, 8 aa, Homo sapiens
  Heavy chain CDR3 for antibody 138 (IGHV3-48)
AQTITLWS

SEQ ID NO: 277 - protein, 8 aa, Homo sapiens
  Light chain CDR3 for antibody 139 (IGKV3-11)
QQRSNWFT

SEQ ID NO: 278 - protein, 17 aa, Homo sapiens
  Heavy chain CDR3 for antibody 139 (IGHV1-69)
ARHSSDGDYYYYYGMDV

SEQ ID NO: 279 - protein, 9 aa, Homo sapiens
  Light chain CDR3 for antibody 140 (IGKV1-39)
QQSYSTPPT

SEQ ID NO: 280 - protein, 17 aa, Homo sapiens
  Heavy chain CDR3 for antibody 140 (IGHV1-2)
ARAGAAGTPYYYYYMDV

SEQ ID NO: 281 - protein, 10 aa, Homo sapiens
  Light chain CDR3 for antibody 141 (IGKV1-9)
QQLNSYPGPT

SEQ ID NO: 282 - protein, 17 aa, Homo sapiens
  Heavy chain CDR3 for antibody 141 (IGHV1-2)
AREPSISRDGYSGYDDY

SEQ ID NO: 283 - protein, 8 aa, Homo sapiens
  Light chain CDR3 for antibody 142 (IGKV1-5)
QQYVTYPT

SEQ ID NO: 284 - protein, 11 aa, Homo sapiens
  Heavy chain CDR3 for antibody 142 (IGHV3-53)
ARDLGPYGMDV

SEQ ID NO: 285 - protein, 9 aa, Homo sapiens
  Light chain CDR3 for antibody 143 (IGKV4-1)
QQYYSTPPT

SEQ ID NO: 286 - protein, 23 aa, Homo sapiens
  Heavy chain CDR3 for antibody 143 (IGHV1-46)
ARDGGRDYDILTGGSYYYYYMDV

SEQ ID NO: 287 - protein, 8 aa, Homo sapiens
  Light chain CDR3 for antibody 144 (IGKV2D-28)
MQALQTPT

SEQ ID NO: 288 - protein, 23 aa, Homo sapiens
  Heavy chain CDR3 for antibody 144 (IGHV1-2)
ARMPRPGWSPSWFGETDHRPLDY

SEQ ID NO: 289 - protein, 9 aa, Homo sapiens
  Light chain CDR3 for antibody 145 (IGKV1-33)
QQYDNLPLT

SEQ ID NO: 290 - protein, 21 aa, Homo sapiens
  Heavy chain CDR3 for antibody 145 (IGHV4/OR15-8)
AREPTVYNWNDMEYYYYGMDV

SEQ ID NO: 291 - protein, 9 aa, Homo sapiens
  Light chain CDR3 for antibody 146 (IGKV1-39)
QQSYSTPPS

SEQ ID NO: 292 - protein, 20 aa, Homo sapiens
  Heavy chain CDR3 for antibody 146 (IGHV5-51)
ARLGVEQQLPPHPNYYGMDV

SEQ ID NO: 293 - protein, 9 aa, Homo sapiens
  Light chain CDR3 for antibody 147 (IGKV2D-28)
MQALQTPYT

SEQ ID NO: 294 - protein, 17 aa, Homo sapiens
  Heavy chain CDR3 for antibody 147 (IGHV1-2)
AREPSISRDGYSGYDDY

SEQ ID NO: 295 - protein, 9 aa, Homo sapiens
  Light chain CDR3 for antibody 148 (IGKV1-6)
LQDYNYPWT

SEQ ID NO: 296 - protein, 17 aa, Homo sapiens
  Heavy chain CDR3 for antibody 148 (IGHV1-69)
ARGLLWFGADYYYGMDV

SEQ ID NO: 297 - protein, 9 aa, Homo sapiens
  Light chain CDR3 for antibody 149 (IGKV1-33)
QQYGRRPLT

SEQ ID NO: 298 - protein, 17 aa, Homo sapiens
  Heavy chain CDR3 for antibody 149 (IGHV2-70)
ARTHYDILTGHEAPFDY

SEQ ID NO: 299 - protein, 9 aa, Homo sapiens
  Light chain CDR3 for antibody 150 (IGKV1-12)
QQANSFPYS

SEQ ID NO: 300 - protein, 12 aa, Homo sapiens
  Heavy chain CDR3 for antibody 150 (IGHV3-66)
ARDLEEQGAFDI

SEQ ID NO: 301 - protein, 10 aa, Homo sapiens [sequence omitted]

SEQ ID NO: 302 - protein, 10 aa, Homo sapiens
  Heavy chain CDR3 for antibody 151 (IGHV3-66)
ARDLRSYYDY

SEQ ID NO: 303 - protein, 9 aa, Homo sapiens
  Light chain CDR3 for antibody 152 (IGKV1-39)
QQSYGIPWT

SEQ ID NO: 304 - protein, 14 aa, Homo sapiens
  Heavy chain CDR3 for antibody 152 (IGHV4-61)
ARSTHQLPVAWFDP

SEQ ID NO: 305 - protein, 9 aa, Homo sapiens
  Light chain CDR3 for antibody 153 (IGKV1-39)
QQSYSTPLT

SEQ ID NO: 306 - protein, 18 aa, Homo sapiens
  Heavy chain CDR3 for antibody 153 (IGHV1-69)
ARGEWEPLSYYYYYYMDV

SEQ ID NO: 307 - protein, 9 aa, Homo sapiens
  Light chain CDR3 for antibody 154 (IGKV2D-28)
MQALQTPYT

SEQ ID NO: 308 - protein, 18 aa, Homo sapiens
  Heavy chain CDR3 for antibody 154 (IGHV2-5)
AHYSGYSYGYPRAYGMDV

SEQ ID NO: 309 - protein, 9 aa, Homo sapiens
  Light chain CDR3 for antibody 155 (IGKV1-39)
QQSYDAPYA

SEQ ID NO: 310 - protein, 17 aa, Homo sapiens
  Heavy chain CDR3 for antibody 155 (IGHV4-4)
ARDSEGLRDYYHYGMDV

SEQ ID NO: 311 - protein, 9 aa, Homo sapiens
  Light chain CDR3 for antibody 156 (IGKV3-20)
QQYGSFLLT

SEQ ID NO: 312 - protein, 23 aa, Homo sapiens
  Heavy chain CDR3 for antibody 156 (IGHV1-69)
ARESSDTGIAVAGPSYYYYYMDV

SEQ ID NO: 313 - protein, 9 aa, Homo sapiens
  Light chain CDR3 for antibody 157 (IGKV1-27)
QKYNSAPLT

SEQ ID NO: 314 - protein, 10 aa, Homo sapiens
  Heavy chain CDR3 for antibody 157 (IGHV4-31)
ARTSGSYFDS

SEQ ID NO: 315 - protein, 9 aa, Homo sapiens
  Light chain CDR3 for antibody 158 (IGKV2D-28)
MQALQTPLT

SEQ ID NO: 316 - protein, 14 aa, Homo sapiens
  Heavy chain CDR3 for antibody 158 (IGHV1-46)
ARGDWNDGWDWFDP

SEQ ID NO: 317 - protein, 10 aa, Homo sapiens
  Light chain CDR3 for antibody 159 (IGKV1-9)
QQVNSYPGPT

SEQ ID NO: 318 - protein, 11 aa, Homo sapiens
  Heavy chain CDR3 for antibody 159 (IGHV3-66)
ARWAWTPIFDY

SEQ ID NO: 319 - protein, 9 aa, Homo sapiens
  Light chain CDR3 for antibody 160 (IGKV1-39)
QQSYSTPPT

SEQ ID NO: 320 - protein, 18 aa, Homo sapiens
  Heavy chain CDR3 for antibody 160 (IGHV2-5)
AHYSGYSYGYPRAYGMDV

SEQ ID NO: 321 - protein, 9 aa, Homo sapiens
  Light chain CDR3 for antibody 161 (IGKV1-12)
QQANSFPFT

SEQ ID NO: 322 - protein, 25 aa, Homo sapiens
  Heavy chain CDR3 for antibody 161 (IGHV1-46)
ARDRSGSGSYSPLTGDSGYYYGMDV

SEQ ID NO: 323 - protein, 8 aa, Homo sapiens
  Light chain CDR3 for antibody 162 (IGKV3-11)
QQRSNWFT

SEQ ID NO: 324 - protein, 16 aa, Homo sapiens
  Heavy chain CDR3 for antibody 162 (IGHV1-18)
ARANPGAVGYYYGMDV

SEQ ID NO: 325 - protein, 9 aa, Homo sapiens
  Light chain CDR3 for antibody 163 (IGKV4-1)
QQYYSTPWT

SEQ ID NO: 326 - protein, 17 aa, Homo sapiens
  Heavy chain CDR3 for antibody 163 (IGHV1-69)
ATHHQPAVLLWFGELFG

SEQ ID NO: 327 - protein, 9 aa, Homo sapiens
  Light chain CDR3 for antibody 164 (IGKV1-12)
QQANSFPYS

SEQ ID NO: 328 - protein, 18 aa, Homo sapiens
  Heavy chain CDR3 for antibody 164 (IGHV2-5)
AHYSGYSYGYPRAYGMDV

SEQ ID NO: 329 - protein, 10 aa, Homo sapiens
  Light chain CDR3 for antibody 165 (IGKV1-33)
QQYDNLPGVT

SEQ ID NO: 330 - protein, 18 aa, Homo sapiens
  Heavy chain CDR3 for antibody 165 (IGHV2-5)
AHYSGYSYGYPRAYGMDV

SEQ ID NO: 331 - protein, 9 aa, Homo sapiens
  Light chain CDR3 for antibody 166 (IGKV1-9)
QQLNSYPVA

SEQ ID NO: 332 - protein, 17 aa, Homo sapiens
  Heavy chain CDR3 for antibody 166 (IGHV1-2)
AREPSISRDGYSGYDDY

SEQ ID NO: 333 - protein, 9 aa, Homo sapiens
  Light chain CDR3 for antibody 167 (IGKV1-9)
QQLNSYPVA

SEQ ID NO: 334 - protein, 9 aa, Homo sapiens
  Heavy chain CDR3 for antibody 167 (IGHV3-53)
ARESYGMDV

SEQ ID NO: 335 - protein, 9 aa, Homo sapiens
  Light chain CDR3 for antibody 168 (IGKV1-39)
QQSYSTPNT

SEQ ID NO: 336 - protein, 15 aa, Homo sapiens
  Heavy chain CDR3 for antibody 168 (IGHV3-30)
ANGQHYYYYYYGMDV

SEQ ID NO: 337 - protein, 9 aa, Homo sapiens
  Light chain CDR3 for antibody 169 (IGKV1-5)
QQYNSYSWT

SEQ ID NO: 338 - protein, 16 aa, Homo sapiens
  Heavy chain CDR3 for antibody 169 (IGHV1-69)
ARVEWGDFDYYYGMDV

SEQ ID NO: 339 - protein, 10 aa, Homo sapiens
  Light chain CDR3 for antibody 170 (IGKV1-39)
QQSYSTPLYS

SEQ ID NO: 340 - protein, 12 aa, Homo sapiens
  Heavy chain CDR3 for antibody 170 (IGHV1-69)
ARAPSDFYGLDV

SEQ ID NO: 341 - protein, 10 aa, Homo sapiens
  Light chain CDR3 for antibody 171 (IGKV1-9)
QQLNSYPGPT

SEQ ID NO: 342 - protein, 11 aa, Homo sapiens
  Heavy chain CDR3 for antibody 171 (IGHV3-53)
ARDLGPYGMDV

SEQ ID NO: 343 - protein, 11 aa, Homo sapiens
  Light chain CDR3 for antibody 172 (IGKV1-33)
QQYDNLPPLYS

SEQ ID NO: 344 - protein, 17 aa, Homo sapiens
  Heavy chain CDR3 for antibody 172 (IGHV4-59)
ARDLGFRALEPGGAFDI

SEQ ID NO: 345 - protein, 9 aa, Homo sapiens
  Light chain CDR3 for antibody 173 (IGKV1-33)
QQYDNLPLT

SEQ ID NO: 346 - protein, 16 aa, Homo sapiens
  Heavy chain CDR3 for antibody 173 (IGHV4-59)
ARVLGGRSGSYYYPDY

SEQ ID NO: 347 - protein, 10 aa, Homo sapiens
  Light chain CDR3 for antibody 174 (IGKV1-9)
QQVNSYPGPT

SEQ ID NO: 348 - protein, 11 aa, Homo sapiens
  Heavy chain CDR3 for antibody 174 (IGHV3-53)
ARDGRGDLWSY

SEQ ID NO: 349 - protein, 9 aa, Homo sapiens
  Light chain CDR3 for antibody 175 (IGKV1-33)
QQYDNLLLT

SEQ ID NO: 350 - protein, 13 aa, Homo sapiens
  Heavy chain CDR3 for antibody 175 (IGHV3-h)
ARTLSPYYYGMDV

SEQ ID NO: 351 - protein, 9 aa, Homo sapiens
  Light chain CDR3 for antibody 176 (IGKV1-12)
QQANSFPFT

SEQ ID NO: 352 - protein, 19 aa, Homo sapiens
  Heavy chain CDR3 for antibody 176 (IGHV4-31)
ARAPSITHFVARVVDAFDI

SEQ ID NO: 353 - protein, 10 aa, Homo sapiens
  Light chain CDR3 for antibody 177 (IGKV1-9)
QQLNSYPGPT

SEQ ID NO: 354 - protein, 22 aa, Homo sapiens
  Heavy chain CDR3 for antibody 177 (IGHV1-46)
AREGGLRVYDSSGYDTGYAFDI

SEQ ID NO: 355 - protein, 10 aa, Homo sapiens [sequence omitted]

SEQ ID NO: 356 - protein, 23 aa, Homo sapiens
  Heavy chain CDR3 for antibody 178 (IGHV1-2)
ARMPRPGWSPSWFGETDHRPLDY

SEQ ID NO: 357 - protein, 9 aa, Homo sapiens
  Light chain CDR3 for antibody 179 (IGKV1-27)
HKYNVVPWT

SEQ ID NO: 358 - protein, 8 aa, Homo sapiens
  Heavy chain CDR3 for antibody 179 (IGHV3-48)
YRGHYSDH

SEQ ID NO: 359 - protein, 10 aa, Homo sapiens
  Light chain CDR3 for antibody 180 (IGKV2-30)
MQGTHWPPPS

SEQ ID NO: 360 - protein, 16 aa, Homo sapiens
  Heavy chain CDR3 for antibody 180 (IGHV4-34)
ARGCSGGSCYPNPFDY

SEQ ID NO: 361 - protein, 9 aa, Homo sapiens
  Light chain CDR3 for antibody 181 (IGKV1-9)
QQLNSYPVA

SEQ ID NO: 362 - protein, 16 aa, Homo sapiens
  Heavy chain CDR3 for antibody 181 (IGHV3-33)
AREVDTAMDRTILWDY

SEQ ID NO: 363 - protein, 8 aa, Homo sapiens
  Light chain CDR3 for antibody 182 (IGKV2D-28)
MQALQTPT

SEQ ID NO: 364 - protein, 12 aa, Homo sapiens
  Heavy chain CDR3 for antibody 182 (IGHV3-66)
ARDLEEQGAFDI

SEQ ID NO: 365 - protein, 10 aa, Homo sapiens
  Light chain CDR3 for antibody 183 (IGKV1-9)
QQLNSYPGPT

SEQ ID NO: 366 - protein, 16 aa, Homo sapiens
  Heavy chain CDR3 for antibody 183 (IGHV4-34)
ARGCSGGSCYPNPFDY

SEQ ID NO: 367 - protein, 8 aa, Homo sapiens
  Light chain CDR3 for antibody 184 (IGKV3-11)
QQRSNWFT

SEQ ID NO: 368 - protein, 12 aa, Homo sapiens
  Heavy chain CDR3 for antibody 184 (IGHV3-66)
ARDLEEQGAFDI

SEQ ID NO: 369 - protein, 9 aa, Homo sapiens
  Light chain CDR3 for antibody 185 (IGKV1-27)
QKYNSAPWT

SEQ ID NO: 370 - protein, 19 aa, Homo sapiens
  Heavy chain CDR3 for antibody 185 (IGHV1-69)
ARAAPDYDFWSGFRNWFDP

SEQ ID NO: 371 - protein, 9 aa, Homo sapiens
  Light chain CDR3 for antibody 186 (IGKV1-9)
QQLNSYPPS

SEQ ID NO: 372 - protein, 17 aa, Homo sapiens
  Heavy chain CDR3 for antibody 186 (IGHV1-69)
ARGLLWFGADYYYGMDV

SEQ ID NO: 373 - protein, 8 aa, Homo sapiens
  Light chain CDR3 for antibody 187 (IGKV2D-28)
MQALQTPT

SEQ ID NO: 374 - protein, 10 aa, Homo sapiens
  Heavy chain CDR3 for antibody 187 (IGHV3-66)
ARDLRSYYDY

SEQ ID NO: 375 - protein, 9 aa, Homo sapiens
  Light chain CDR3 for antibody 188 (IGKV1-39)
QQSYSTPLT

SEQ ID NO: 376 - protein, 16 aa, Homo sapiens
  Heavy chain CDR3 for antibody 188 (IGHV1-69)
ARVEWGDFDYYYGMDV

SEQ ID NO: 377 - protein, 9 aa, Homo sapiens
  Light chain CDR3 for antibody 189 (IGKV3-20)
QQYGSSLYT

SEQ ID NO: 378 - protein, 17 aa, Homo sapiens
  Heavy chain CDR3 for antibody 189 (IGHV1-2)
AREPSISRDGYSGYDDY

SEQ ID NO: 379 - protein, 9 aa, Homo sapiens
  Light chain CDR3 for antibody 190 (IGKV1-12)
QQANSFPYS

SEQ ID NO: 380 - protein, 17 aa, Homo sapiens
  Heavy chain CDR3 for antibody 190 (IGHV1-2)
ARAGAAGTPYYYYYMDV

SEQ ID NO: 381 - protein, 11 aa, Homo sapiens
  Light chain CDR3 for antibody 191 (IGKV3-15)
QQYNNWPPMYT

SEQ ID NO: 382 - protein, 12 aa, Homo sapiens
  Heavy chain CDR3 for antibody 191 (IGHV3-66)
ARDLSAAGGFDY

SEQ ID NO: 383 - protein, 9 aa, Homo sapiens
  Light chain CDR3 for antibody 192 (IGKV3-20)
QQYGSSPWT

SEQ ID NO: 384 - protein, 6 aa, Homo sapiens
  Heavy chain CDR3 for antibody 192 (IGHV4-59)
ARGFDY

SEQ ID NO: 385 - protein, 10 aa, Homo sapiens
  Light chain CDR3 for antibody 193 (IGKV1-9)
QQLDTYPGPT

SEQ ID NO: 386 - protein, 18 aa, Homo sapiens
  Heavy chain CDR3 for antibody 193 (IGHV2-5)
AHYSGYSYGYPRAYGMDV

SEQ ID NO: 387 - protein, 9 aa, Homo sapiens
  Light chain CDR3 for antibody 194 (IGKV2D-28)
MQALQTPYT

SEQ ID NO: 388 - protein, 12 aa, Homo sapiens
  Heavy chain CDR3 for antibody 194 (IGHV3-66)
ARDLSAAGGFDY

SEQ ID NO: 389 - protein, 8 aa, Homo sapiens
  Light chain CDR3 for antibody 195 (IGKV3-11)
QQRSNWFT

SEQ ID NO: 390 - protein, 16 aa, Homo sapiens
  Heavy chain CDR3 for antibody 195 (IGHV3-33)
AREVDTAMDRTILWDY

SEQ ID NO: 391 - protein, 9 aa, Homo sapiens
  Light chain CDR3 for antibody 196 (IGKV1-39)
QQSYSNPWT

SEQ ID NO: 392 - protein, 11 aa, Homo sapiens
  Heavy chain CDR3 for antibody 196 (IGHV3-30)
ARDWAIHSFDY

SEQ ID NO: 393 - protein, 9 aa, Homo sapiens
  Light chain CDR3 for antibody 197 (IGKV1-5)
QQYHTSPWT

SEQ ID NO: 394 - protein, 7 aa, Homo sapiens
  Heavy chain CDR3 for antibody 197 (IGHV4-39)
ARGVPGD

SEQ ID NO: 395 - protein, 9 aa, Homo sapiens
  Light chain CDR3 for antibody 198 (IGKV3-20)
QQYGSSLYT

SEQ ID NO: 396 - protein, 17 aa, Homo sapiens
  Heavy chain CDR3 for antibody 198 (IGHV1-69)
ARGLLWFGADYYYGMDV

SEQ ID NO: 397 - protein, 9 aa, Homo sapiens
  Light chain CDR3 for antibody 199 (IGKV1-39)
QQSYSTPFT

SEQ ID NO: 398 - protein, 23 aa, Homo sapiens
  Heavy chain CDR3 for antibody 199 (IGHV1-8)
ARGVGSYYDFWSGWDYYYYYMDV

SEQ ID NO: 399 - protein, 10 aa, Homo sapiens
  Light chain CDR3 for antibody 200 (IGKV1-12)
QQSYSTPPWT

SEQ ID NO: 400 - protein, 16 aa, Homo sapiens
  Heavy chain CDR3 for antibody 200 (IGHV3-53)
AKWARGGDVDYYGMDV

SEQ ID NO: 401 - protein, 10 aa, Homo sapiens
  Light chain CDR3 for antibody 201 (IGKV1-9)
QQLNSYPGPT

SEQ ID NO: 402 - protein, 17 aa, Homo sapiens
  Heavy chain CDR3 for antibody 201 (IGHV4/OR15-8)
ARDLTDYGDHGGYWFDP

SEQ ID NO: 403 - protein, 10 aa, Homo sapiens
  Light chain CDR3 for antibody 202 (IGKV1-39)
QQSYGSPRFT

SEQ ID NO: 404 - protein, 18 aa, Homo sapiens
  Heavy chain CDR3 for antibody 202 (IGHV2/OR16-5)
ARVFLELRLFYFYYYMDV

SEQ ID NO: 405 - protein, 10 aa, Homo sapiens
  Light chain CDR3 for antibody 203 (IGKV3-11)
QQRSNWPPYS

SEQ ID NO: 406 - protein, 15 aa, Homo sapiens
  Heavy chain CDR3 for antibody 203 (IGHV1-69)
ARPRVDRTRLGAFDI

SEQ ID NO: 407 - protein, 9 aa, Homo sapiens
  Light chain CDR3 for antibody 204 (IGKV1-33)
QQYDNLPPA

SEQ ID NO: 408 - protein, 10 aa, Homo sapiens
  Heavy chain CDR3 for antibody 204 (IGHV3-30)
ARDLRSYYDY

SEQ ID NO: 409 - protein, 9 aa, Homo sapiens
  Light chain CDR3 for antibody 205 (IGKV1-9)
QQLNIDRDT

SEQ ID NO: 410 - protein, 18 aa, Homo sapiens
  Heavy chain CDR3 for antibody 205 (IGHV4-31)
ARDFQALSGSYYPFYMDV

SEQ ID NO: 411 - protein, 8 aa, Homo sapiens
  Light chain CDR3 for antibody 206 (IGKV3-11)
QQRSNWFT

SEQ ID NO: 412 - protein, 11 aa, Homo sapiens
  Heavy chain CDR3 for antibody 206 (IGHV3-53)
ARDLGPYGMDV

SEQ ID NO: 413 - protein, 10 aa, Homo sapiens
  Light chain CDR3 for antibody 207 (IGKV3-11)
QQRSNWPPYS

SEQ ID NO: 414 - protein, 17 aa, Homo sapiens
  Heavy chain CDR3 for antibody 207 (IGHV4-59)
AGSPRGWLEQQPGYFDY

SEQ ID NO: 415 - protein, 9 aa, Homo sapiens
  Light chain CDR3 for antibody 208 (IGKV1-5)
QQYNSYPWT

SEQ ID NO: 416 - protein, 23 aa, Homo sapiens
  Heavy chain CDR3 for antibody 208 (IGHV4-39)
ARVSYDFWSGSPIHYYYYYYMDV

SEQ ID NO: 417 - protein, 10 aa, Homo sapiens
  Light chain CDR3 for antibody 209 (IGKV1-9)
QQVNSYPGPT

SEQ ID NO: 418 - protein, 14 aa, Homo sapiens
  Heavy chain CDR3 for antibody 209 (IGHV3-13)
ARGGGSSWYWYFDL

SEQ ID NO: 419 - protein, 8 aa, Homo sapiens
  Light chain CDR3 for antibody 210 (IGKV2D-28)
MQALQTPT

SEQ ID NO: 420 - protein, 22 aa, Homo sapiens
  Heavy chain CDR3 for antibody 210 (IGHV1-46)
AREGGLRVYDSSGYDTGYAFDI

SEQ ID NO: 421 - protein, 9 aa, Homo sapiens
  Light chain CDR3 for antibody 211 (IGKV3-20)
QQYASSPIT

SEQ ID NO: 422 - protein, 12 aa, Homo sapiens
  Heavy chain CDR3 for antibody 211 (IGHV3-66)
ARDLSAAGGFDY

SEQ ID NO: 423 - protein, 9 aa, Homo sapiens
  Light chain CDR3 for antibody 212 (IGKV1-39)
QQSYSTPRT

SEQ ID NO: 424 - protein, 15 aa, Homo sapiens
  Heavy chain CDR3 for antibody 212 (IGHV4-59)
ARGVKGLWLFDAFDI

SEQ ID NO: 425 - protein, 10 aa, Homo sapiens
  Light chain CDR3 for antibody 213 (IGKV1-33)
QQYDNLPWRS

SEQ ID NO: 426 - protein, 12 aa, Homo sapiens
  Heavy chain CDR3 for antibody 213 (IGHV3-66)
ARDLSAAGGFDY

SEQ ID NO: 427 - protein, 9 aa, Homo sapiens
  Light chain CDR3 for antibody 214 (IGKV1-39)
QQSYSTPFT

SEQ ID NO: 428 - protein, 13 aa, Homo sapiens
  Heavy chain CDR3 for antibody 214 (IGHV1-f)
ALWFGELFRWFDP

SEQ ID NO: 429 - protein, 9 aa, Homo sapiens
  Light chain CDR3 for antibody 215 (IGKV1-9)
QQLNSYSYT

SEQ ID NO: 430 - protein, 10 aa, Homo sapiens
  Heavy chain CDR3 for antibody 215 (IGHV3-66)
ARDLRSYYDY

SEQ ID NO: 431 - protein, 10 aa, Homo sapiens
  Light chain CDR3 for antibody 216 (IGKV1-12)
QQVNSYPGPT

SEQ ID NO: 432 - protein, 20 aa, Homo sapiens
  Heavy chain CDR3 for antibody 216 (IGHV3-13)
ARVGYYYDSSGLKHYWYFDL

SEQ ID NO: 433 - protein, 11 aa, Homo sapiens
  Light chain CDR3 for antibody 217 (IGKV1-12)
QQANSFPPQFT

SEQ ID NO: 434 - protein, 11 aa, Homo sapiens
  Heavy chain CDR3 for antibody 217 (IGHV3-66)
ARETMVYGMDV

SEQ ID NO: 435 - protein, 9 aa, Homo sapiens
  Light chain CDR3 for antibody 218 (IGKV1-27)
QKYNSAPLT

SEQ ID NO: 436 - protein, 23 aa, Homo sapiens
  Heavy chain CDR3 for antibody 218 (IGHV1-2)
ARVRDYDFWSGYPDTYYYYYMDV

SEQ ID NO: 437 - protein, 9 aa, Homo sapiens
  Light chain CDR3 for antibody 219 (IGKV1-39)
QQSYSTPPT

SEQ ID NO: 438 - protein, 10 aa, Homo sapiens
  Heavy chain CDR3 for antibody 219 (IGHV3-66)
ARDLRSYYDY

SEQ ID NO: 439 - protein, 10 aa, Homo sapiens
  Light chain CDR3 for antibody 220 (IGKV1-39)
QQSYSTPPLT

SEQ ID NO: 440 - protein, 18 aa, Homo sapiens
  Heavy chain CDR3 for antibody 220 (IGHV2-5)
AHYSGYSYGYPRAYGMDV

SEQ ID NO: 441 - protein, 9 aa, Homo sapiens
  Light chain CDR3 for antibody 221 (IGKV1-6)
LQDYNYPWT

SEQ ID NO: 442 - protein, 17 aa, Homo sapiens
  Heavy chain CDR3 for antibody 221 (IGHV1-2)
AREPSISRDGYSGYDDY

SEQ ID NO: 443 - protein, 11 aa, Homo sapiens
  Light chain CDR3 for antibody 222 (IGKV1-12)
QQANSFPPLFT

SEQ ID NO: 444 - protein, 11 aa, Homo sapiens
  Heavy chain CDR3 for antibody 222 (IGHV3-53)
ARDLQVYGMDV

SEQ ID NO: 445 - protein, 10 aa, Homo sapiens [sequence omitted]

SEQ ID NO: 446 - protein, 22 aa, Homo sapiens
  Heavy chain CDR3 for antibody 223 (IGHV1-46)
AREGGLRVYDSSGYDTGYAFDI

SEQ ID NO: 447 - protein, 9 aa, Homo sapiens
  Light chain CDR3 for antibody 224 (IGKV3-20)
QQYGSSLYT

SEQ ID NO: 448 - protein, 12 aa, Homo sapiens
  Heavy chain CDR3 for antibody 224 (IGHV3-66)
ARDLSAAGGFDY

SEQ ID NO: 449 - protein, 9 aa, Homo sapiens
  Light chain CDR3 for antibody 225 (IGKV3-11)
QQRRNWPLT

SEQ ID NO: 450 - protein, 16 aa, Homo sapiens
  Heavy chain CDR3 for antibody 225 (IGHV3-23)
AKDRMTAPLHYWYFDL

SEQ ID NO: 451 - protein, 9 aa, Homo sapiens
  Light chain CDR3 for antibody 226 (IGKV3-20)
QQYRNSPWT

SEQ ID NO: 452 - protein, 12 aa, Homo sapiens
  Heavy chain CDR3 for antibody 226 (IGHV3-15)
TKVGQFGEFFDY

SEQ ID NO: 453 - protein, 10 aa, Homo sapiens
  Light chain CDR3 for antibody 227 (IGKV1-39)
QQSYSTPALT

SEQ ID NO: 454 - protein, 13 aa, Homo sapiens
  Heavy chain CDR3 for antibody 227 (IGHV4-b)
ARSPRGDFYYFDY

SEQ ID NO: 455 - protein, 9 aa, Homo sapiens
  Light chain CDR3 for antibody 228 (IGKV1-6)
LQDYNYPWT

SEQ ID NO: 456 - protein, 20 aa, Homo sapiens
  Heavy chain CDR3 for antibody 228 (IGHV2-26)
ARTTYYYDSSGYYPLNYFDY

SEQ ID NO: 457 - protein, 9 aa, Homo sapiens
  Light chain CDR3 for antibody 229 (IGKV1-13)
QQFNTYPLT

SEQ ID NO: 458 - protein, 25 aa, Homo sapiens
  Heavy chain CDR3 for antibody 229 (IGHV3-30)
AKVTPGGSGRGTGPLGYYYYYGMDV

SEQ ID NO: 459 - protein, 10 aa, Homo sapiens
  Light chain CDR3 for antibody 230 (IGKV3-11)
QQRSNWPPYS

SEQ ID NO: 460 - protein, 16 aa, Homo sapiens
  Heavy chain CDR3 for antibody 230 (IGHV1-69)
ARDHSGSYYYYYGMDV

SEQ ID NO: 461 - protein, 9 aa, Homo sapiens
  Light chain CDR3 for antibody 231 (IGKV1-12)
QQANSFPYS

SEQ ID NO: 462 - protein, 17 aa, Homo sapiens
  Heavy chain CDR3 for antibody 231 (IGHV1-69)
ARGLLWFGADYYYGMDV

SEQ ID NO: 463 - protein, 9 aa, Homo sapiens
  Light chain CDR3 for antibody 232 (IGKV1-39)
QQIYETPYT

SEQ ID NO: 464 - protein, 14 aa, Homo sapiens
  Heavy chain CDR3 for antibody 232 (IGHV1-46)
ARADFGVYYSPFDF

SEQ ID NO: 465 - protein, 9 aa, Homo sapiens
  Light chain CDR3 for antibody 233 (IGKV1-39)
QQSYSTPLT

SEQ ID NO: 466 - protein, 23 aa, Homo sapiens
  Heavy chain CDR3 for antibody 233 (IGHV1-2)
ARMPRPGWSPSWFGETDHRPLDY

SEQ ID NO: 467 - protein, 9 aa, Homo sapiens
  Light chain CDR3 for antibody 234 (IGKV3-20)
QQYDSLPIT

SEQ ID NO: 468 - protein, 15 aa, Homo sapiens
  Heavy chain CDR3 for antibody 234 (IGHV3-11)
VKGYSYGYYYYAMDV

SEQ ID NO: 469 - protein, 8 aa, Homo sapiens
  Light chain CDR3 for antibody 235 (IGKV2D-28)
MQALQTPT

SEQ ID NO: 470 - protein, 11 aa, Homo sapiens
  Heavy chain CDR3 for antibody 235 (IGHV3-66)
ARETMVYGMDV

SEQ ID NO: 471 - protein, 9 aa, Homo sapiens
  Light chain CDR3 for antibody 236 (IGKV1-39)
QQSYSTPFT

SEQ ID NO: 472 - protein, 17 aa, Homo sapiens
  Heavy chain CDR3 for antibody 236 (IGHV1-69)
ARQPWGSSSDYYYYMDV

SEQ ID NO: 473 - protein, 10 aa, Homo sapiens [sequence omitted]

SEQ ID NO: 474 - protein, 11 aa, Homo sapiens
  Heavy chain CDR3 for antibody 237 (IGHV3-53)
ARDLQPYGMDV

SEQ ID NO: 475 - protein, 9 aa, Homo sapiens
  Light chain CDR3 for antibody 238 (IGKV1-6)
LQDYNYPWT

SEQ ID NO: 476 - protein, 11 aa, Homo sapiens
  Heavy chain CDR3 for antibody 238 (IGHV3-53)
ARDLQPYGMDV

SEQ ID NO: 477 - protein, 10 aa, Homo sapiens
  Light chain CDR3 for antibody 239 (IGKV1-39)
QQSYSTPPLT

SEQ ID NO: 478 - protein, 10 aa, Homo sapiens
  Heavy chain CDR3 for antibody 239 (IGHV3-13)
ARDLRSYYDY

SEQ ID NO: 479 - protein, 9 aa, Homo sapiens
  Light chain CDR3 for antibody 240 (IGKV1-33)
QQYDNLPPT

SEQ ID NO: 480 - protein, 17 aa, Homo sapiens
  Heavy chain CDR3 for antibody 240 (IGHV1-2)
ARAGAAGTPYYYYYMDV

SEQ ID NO: 481 - protein, 9 aa, Homo sapiens
  Light chain CDR3 for antibody 241 (IGKV1-17)
LQHNSYPRT

SEQ ID NO: 482 - protein, 12 aa, Homo sapiens
  Heavy chain CDR3 for antibody 241 (IGHV3-66)
ARDLSAAGGFDY

SEQ ID NO: 483 - protein, 9 aa, Homo sapiens
  Light chain CDR3 for antibody 242 (IGKV1-39)
QQSHTFPLT

SEQ ID NO: 484 - protein, 17 aa, Homo sapiens
  Heavy chain CDR3 for antibody 242 (IGHV1-2)
ARAGAAGTPYYYYYMDV

SEQ ID NO: 485 - protein, 9 aa, Homo sapiens
  Light chain CDR3 for antibody 243 (IGKV1-9)
QQLTSYSYT

SEQ ID NO: 486 - protein, 18 aa, Homo sapiens
  Heavy chain CDR3 for antibody 243 (IGHV2-5)
AHYSGYSYGYPRAYGMDV

SEQ ID NO: 487 - protein, 10 aa, Homo sapiens
  Light chain CDR3 for antibody 244 (IGKV3-15)
QQYNNWPPLT

SEQ ID NO: 488 - protein, 17 aa, Homo sapiens
  Heavy chain CDR3 for antibody 244 (IGHV4/OR15-8)
ARDLTDYGDHGGYWFDP

SEQ ID NO: 489 - protein, 9 aa, Homo sapiens
  Light chain CDR3 for antibody 245 (IGKV1-17)
LQHNSYPWT

SEQ ID NO: 490 - protein, 11 aa, Homo sapiens
  Heavy chain CDR3 for antibody 245 (IGHV4-59)
ARGTGNPGFDS

SEQ ID NO: 491 - protein, 10 aa, Homo sapiens
  Light chain CDR3 for antibody 246 (IGKV1-39)
QQSYSTSLYT

SEQ ID NO: 492 - protein, 16 aa, Homo sapiens
  Heavy chain CDR3 for antibody 246 (IGHV3-13)
ARASYDSSGYYQHFDY

SEQ ID NO: 493 - protein, 9 aa, Homo sapiens
  Light chain CDR3 for antibody 247 (IGKV1-39)
QQSYSTPLT

SEQ ID NO: 494 - protein, 17 aa, Homo sapiens
  Heavy chain CDR3 for antibody 247 (IGHV4-59)
ARSPRGWLEQQPGYFDY

SEQ ID NO: 495 - protein, 8 aa, Homo sapiens
  Light chain CDR3 for antibody 248 (IGKV3-11)
QQRSNWFT

SEQ ID NO: 496 - protein, 9 aa, Homo sapiens
  Heavy chain CDR3 for antibody 248 (IGHV3-53)
ARESYGMDV

SEQ ID NO: 497 - protein, 10 aa, Homo sapiens
  Light chain CDR3 for antibody 249 (IGKV1-9)
QQLNSYPGPT

SEQ ID NO: 498 - protein, 18 aa, Homo sapiens
  Heavy chain CDR3 for antibody 249 (IGHV3-30)
AKDGSWYYDSSGYPVFDY

SEQ ID NO: 499 - protein, 9 aa, Homo sapiens
  Light chain CDR3 for antibody 250 (IGKV1-9)
QQLNSYPPS

SEQ ID NO: 500 - protein, 23 aa, Homo sapiens
  Heavy chain CDR3 for antibody 250 (IGHV1-46)
ARMPRPGWSPSWFGETDHRPLDY

SEQ ID NO: 501 - protein, 10 aa, Homo sapiens
  Light chain CDR3 for antibody 251 (IGKV3-11)
QQRSNWPRAT

SEQ ID NO: 502 - protein, 17 aa, Homo sapiens
  Heavy chain CDR3 for antibody 251 (IGHV1-2)
ARAGAAGTPYYYYYMDV

SEQ ID NO: 503 - protein, 9 aa, Homo sapiens
  Light chain CDR3 for antibody 252 (IGKV1-39)
QQSYSTPPT

SEQ ID NO: 504 - protein, 17 aa, Homo sapiens
  Heavy chain CDR3 for antibody 252 (IGHV1-69)
ARGLLWFGADYYYGMDV

SEQ ID NO: 505 - protein, 9 aa, Homo sapiens
  Light chain CDR3 for antibody 253 (IGKV4-1)
QQYYSTPLT

SEQ ID NO: 506 - protein, 15 aa, Homo sapiens
  Heavy chain CDR3 for antibody 253 (IGHV4-31)
ARARRMVYVIDAFDI

SEQ ID NO: 507 - protein, 10 aa, Homo sapiens
  Light chain CDR3 for antibody 254 (IGKV1-9)
QQVNSYPGPT

SEQ ID NO: 508 - protein, 23 aa, Homo sapiens
  Heavy chain CDR3 for antibody 254 (IGHV1-2)
ARMPRPGWSPSWFGETDHRPLDY

SEQ ID NO: 509 - protein, 9 aa, Homo sapiens
  Light chain CDR3 for antibody 255 (IGKV3-20)
QQYDSSPLT

SEQ ID NO: 510 - protein, 11 aa, Homo sapiens
  Heavy chain CDR3 for antibody 255 (IGHV4-31)
ARRVSGYHFDS

SEQ ID NO: 511 - protein, 9 aa, Homo sapiens
  Light chain CDR3 for antibody 256 (IGKV1-17)
LQHNSYPRT

SEQ ID NO: 512 - protein, 18 aa, Homo sapiens
  Heavy chain CDR3 for antibody 256 (IGHV2-5)
AHYSGYSYGYPRAYGMDV

SEQ ID NO: 513 - protein, 8 aa, Homo sapiens
  Light chain CDR3 for antibody 257 (IGKV3-15)
QQYNNWRT

SEQ ID NO: 514 - protein, 16 aa, Homo sapiens
  Heavy chain CDR3 for antibody 257 (IGHV2-70)
ARMPLGGFWSGGYFDY

SEQ ID NO: 515 - protein, 10 aa, Homo sapiens
  Light chain CDR3 for antibody 258 (IGKV1-9)
QQLNSYPGPT

SEQ ID NO: 516 - protein, 20 aa, Homo sapiens
  Heavy chain CDR3 for antibody 258 (IGHV2-26)
ARTTYYYDSSGYYPLNYFDY

SEQ ID NO: 517 - protein, 9 aa, Homo sapiens
  Light chain CDR3 for antibody 259 (IGKV1-39)
QQSYSTPNT

SEQ ID NO: 518 - protein, 24 aa, Homo sapiens
  Heavy chain CDR3 for antibody 259 (IGHV1-8)
ARVIPDYYDSSGSPHDYYYYGMDV

SEQ ID NO: 519 - protein, 11 aa, Homo sapiens
  Light chain CDR3 for antibody 260 (IGKV1-12)
QQANSFPPLFT

SEQ ID NO: 520 - protein, 17 aa, Homo sapiens
  Heavy chain CDR3 for antibody 260 (IGHV1-2)
ARAGAAGTPYYYYYMDV

SEQ ID NO: 521 - protein, 9 aa, Homo sapiens
  Light chain CDR3 for antibody 261 (IGKV3-20)
QQYGSSPLT

SEQ ID NO: 522 - protein, 19 aa, Homo sapiens
  Heavy chain CDR3 for antibody 261 (IGHV4-59)
ARASHSTIFGVVIIQQFDY

SEQ ID NO: 523 - protein, 9 aa, Homo sapiens
  Light chain CDR3 for antibody 262 (IGKV1-12)
QQANSFPYS

SEQ ID NO: 524 - protein, 21 aa, Homo sapiens
  Heavy chain CDR3 for antibody 262 (IGHV4/OR15-8)
ARDRGRYYDSSGYEEMYAFDI

SEQ ID NO: 525 - protein, 9 aa, Homo sapiens
  Light chain CDR3 for antibody 263 (IGKV1-39)
QQSHTFPLT

SEQ ID NO: 526 - protein, 11 aa, Homo sapiens
  Heavy chain CDR3 for antibody 263 (IGHV1-69)
ASSSLWFSLDP

SEQ ID NO: 527 - protein, 9 aa, Homo sapiens
  Light chain CDR3 for antibody 264 (IGKV1-9)
QQLNSYPVA

SEQ ID NO: 528 - protein, 14 aa, Homo sapiens
  Heavy chain CDR3 for antibody 264 (IGHV3-13)
ARGGGSSWYWYFDL

SEQ ID NO: 529 - protein, 10 aa, Homo sapiens
  Light chain CDR3 for antibody 265 (IGKV1-12)
QQLNSYPGPT

SEQ ID NO: 530 - protein, 13 aa, Homo sapiens
  Heavy chain CDR3 for antibody 265 (IGHV4-31)
ARDYGGNSAQFGY

SEQ ID NO: 531 - protein, 10 aa, Homo sapiens
  Light chain CDR3 for antibody 266 (IGKV3-NL1)
QQYGSSPSFT

SEQ ID NO: 532 - protein, 10 aa, Homo sapiens
  Heavy chain CDR3 for antibody 266 (IGHV3-66)
ARDLRSYYDY

SEQ ID NO: 533 - protein, 9 aa, Homo sapiens
  Light chain CDR3 for antibody 267 (IGKV1-9)
QQLNSYPVA

SEQ ID NO: 534 - protein, 11 aa, Homo sapiens
  Heavy chain CDR3 for antibody 267 (IGHV3-53)
ARDGRGDLWSY

SEQ ID NO: 535 - protein, 8 aa, Homo sapiens
  Light chain CDR3 for antibody 268 (IGKV3-11)
QQRSNWFT

SEQ ID NO: 536 - protein, 20 aa, Homo sapiens
  Heavy chain CDR3 for antibody 268 (IGHV1-2)
ASGTYYYDSSGYYWNDAFDI

SEQ ID NO: 537 - protein, 10 aa, Homo sapiens
  Light chain CDR3 for antibody 269 (IGKV1-12)
QQANSFPRLT

SEQ ID NO: 538 - protein, 22 aa, Homo sapiens
  Heavy chain CDR3 for antibody 269 (IGHV1-8)
ARVRSDYDYVWGSYPPEYYFDY

SEQ ID NO: 539 - protein, 9 aa, Homo sapiens
  Light chain CDR3 for antibody 270 (IGKV1-12)
QQANSFPYS

SEQ ID NO: 540 - protein, 9 aa, Homo sapiens
  Heavy chain CDR3 for antibody 270 (IGHV3-53)
ARESYGMDV

SEQ ID NO: 541 - protein, 10 aa, Homo sapiens
  Light chain CDR3 for antibody 271 (IGKV1-33)
QQYDNLPGVT

SEQ ID NO: 542 - protein, 17 aa, Homo sapiens
  Heavy chain CDR3 for antibody 271 (IGHV1-2)
ARAGAAGTPYYYYYMDV

SEQ ID NO: 543 - protein, 9 aa, Homo sapiens
  Light chain CDR3 for antibody 272 (IGKV1-33)
QQYDNLPLT

SEQ ID NO: 544 - protein, 12 aa, Homo sapiens
  Heavy chain CDR3 for antibody 272 (IGHV3-66)
ARDLEEQGAFDI

SEQ ID NO: 545 - protein, 9 aa, Homo sapiens
  Light chain CDR3 for antibody 273 (IGKV1-12)
QQANSFPFT

SEQ ID NO: 546 - protein, 13 aa, Homo sapiens
  Heavy chain CDR3 for antibody 273 (IGHV1-24)
ATVRIQLWFGFDY

SEQ ID NO: 547 - protein, 8 aa, Homo sapiens
  Light chain CDR3 for antibody 274 (IGKV3-11)
QQRSNWFT

SEQ ID NO: 548 - protein, 20 aa, Homo sapiens
  Heavy chain CDR3 for antibody 274 (IGHV2-26)
ARTTYYYDSSGYYPLNYFDY

SEQ ID NO: 549 - protein, 9 aa, Homo sapiens
  Light chain CDR3 for antibody 275 (IGKV1-39)
QQSYSTPPT

SEQ ID NO: 550 - protein, 12 aa, Homo sapiens
  Heavy chain CDR3 for antibody 275 (IGHV3-66)
ARDLEEQGAFDI

SEQ ID NO: 551 - protein, 8 aa, Homo sapiens
  Light chain CDR3 for antibody 276 (IGKV2D-28)
MQALQTPT

SEQ ID NO: 552 - protein, 19 aa, Homo sapiens
  Heavy chain CDR3 for antibody 276 (IGHV1-69)
ARAHRSSTSYRLGINWFDP

SEQ ID NO: 553 - protein, 8 aa, Homo sapiens
  Light chain CDR3 for antibody 277 (IGKV3-11)
QQRSNWFT

SEQ ID NO: 554 - protein, 11 aa, Homo sapiens
  Heavy chain CDR3 for antibody 277 (IGHV3-66)
ARETMVYGMDV

SEQ ID NO: 555 - protein, 9 aa, Homo sapiens
  Light chain CDR3 for antibody 278 (IGKV1-9)
QQLNSYPVA

SEQ ID NO: 556 - protein, 16 aa, Homo sapiens
  Heavy chain CDR3 for antibody 278 (IGHV4-34)
ARGCSGGSCYPNPFDY

SEQ ID NO: 557 - protein, 10 aa, Homo sapiens [sequence omitted]

SEQ ID NO: 558 - protein, 16 aa, Homo sapiens
  Heavy chain CDR3 for antibody 279 (IGHV1-18)
ARANPGAVGYYYGMDV

SEQ ID NO: 559 - protein, 9 aa, Homo sapiens
  Light chain CDR3 for antibody 280 (IGKV1-39)
QQSYSTPWT

SEQ ID NO: 560 - protein, 11 aa, Homo sapiens
  Heavy chain CDR3 for antibody 280 (IGHV3-53)
ARDLGPYGMDV

SEQ ID NO: 561 - protein, 8 aa, Homo sapiens
  Light chain CDR3 for antibody 281 (IGKV3-11)
QQRSNWFT

SEQ ID NO: 562 - protein, 16 aa, Homo sapiens
  Heavy chain CDR3 for antibody 281 (IGHV4-34)
ARGCSGGSCYPNPFDY

SEQ ID NO: 563 - protein, 9 aa, Homo sapiens
  Light chain CDR3 for antibody 282 (IGKV2D-30)
MQGTHWPPT

SEQ ID NO: 564 - protein, 12 aa, Homo sapiens
  Heavy chain CDR3 for antibody 282 (IGHV3-66)
ARDLSAAGGFDY

SEQ ID NO: 565 - protein, 11 aa, Homo sapiens
  Light chain CDR3 for antibody 283 (IGKV1-12)
QQANSFPPLFT

SEQ ID NO: 566 - protein, 18 aa, Homo sapiens
  Heavy chain CDR3 for antibody 283 (IGHV2-5)
AHYSGYSYGYPRAYGMDV

SEQ ID NO: 567 - protein, 10 aa, Homo sapiens
  Light chain CDR3 for antibody 284 (IGKV1-33)
QQYDNLPSLT

SEQ ID NO: 568 - protein, 12 aa, Homo sapiens
  Heavy chain CDR3 for antibody 284 (IGHV3-66)
ARDLEEQGAFDI

SEQ ID NO: 569 - protein, 8 aa, Homo sapiens
  Light chain CDR3 for antibody 285 (IGKV1-13)
QQFNSYPS

SEQ ID NO: 570 - protein, 12 aa, Homo sapiens
  Heavy chain CDR3 for antibody 285 (IGHV3-66)
ARDLSAAGGFDY

SEQ ID NO: 571 - protein, 9 aa, Homo sapiens
  Light chain CDR3 for antibody 286 (IGKV1-6)
LQDYNYPWT

SEQ ID NO: 572 - protein, 9 aa, Homo sapiens
  Heavy chain CDR3 for antibody 286 (IGHV4/OR15-8)
ARVLGAMFT

SEQ ID NO: 573 - protein, 9 aa, Homo sapiens
  Light chain CDR3 for antibody 287 (IGKV1-12)
QQANSFPYS

SEQ ID NO: 574 - protein, 11 aa, Homo sapiens
  Heavy chain CDR3 for antibody 287 (IGHV3-53)
ARDLQPYGMDV

SEQ ID NO: 575 - protein, 11 aa, Homo sapiens
  Light chain CDR3 for antibody 288 (IGKV1-12)
QQANSFPPQFT

SEQ ID NO: 576 - protein, 17 aa, Homo sapiens
  Heavy chain CDR3 for antibody 288 (IGHV1-69)
ARGLLWFGADYYYGMDV

SEQ ID NO: 577 - protein, 10 aa, Homo sapiens
  Light chain CDR3 for antibody 289 (IGKV1-9)
QQLNSYPGPT

SEQ ID NO: 578 - protein, 13 aa, Homo sapiens
  Heavy chain CDR3 for antibody 289 (IGHV4-31)
ARDYGGNANYFDY

SEQ ID NO: 579 - protein, 10 aa, Homo sapiens
  Light chain CDR3 for antibody 290 (IGKV1-9)
QQLNSYPPIT

SEQ ID NO: 580 - protein, 12 aa, Homo sapiens
  Heavy chain CDR3 for antibody 290 (IGHV3-66)
ARDLSAAGGFDY

SEQ ID NO: 581 - protein, 9 aa, Homo sapiens
  Light chain CDR3 for antibody 291 (IGKV1-5)
QHYDRYPPA

SEQ ID NO: 582 - protein, 15 aa, Homo sapiens
  Heavy chain CDR3 for antibody 291 (IGHV3/OR16-1)
ARGVYSSGRCDVFDI

SEQ ID NO: 583 - protein, 9 aa, Homo sapiens
  Light chain CDR3 for antibody 292 (IGKV1-6)
LQDYNYPWT

SEQ ID NO: 584 - protein, 9 aa, Homo sapiens
  Heavy chain CDR3 for antibody 292 (IGHV3-53)
ARESYGMDV

SEQ ID NO: 585 - protein, 9 aa, Homo sapiens
  Light chain CDR3 for antibody 293 (IGKV1-12)
QQANSFPYS

SEQ ID NO: 586 - protein, 19 aa, Homo sapiens
  Heavy chain CDR3 for antibody 293 (IGHV4-31)
ARCTTTTQWLKMVVNWFDP

SEQ ID NO: 587 - protein, 9 aa, Homo sapiens
  Light chain CDR3 for antibody 294 (IGKV2D-28)
MQALQTPYT

SEQ ID NO: 588 - protein, 12 aa, Homo sapiens
  Heavy chain CDR3 for antibody 294 (IGHV3-66)
ARDLEEQGAFDI

SEQ ID NO: 589 - protein, 9 aa, Homo sapiens
  Light chain CDR3 for antibody 295 (IGKV2-30)
MQGTHWPPG

SEQ ID NO: 590 - protein, 24 aa, Homo sapiens
  Heavy chain CDR3 for antibody 295 (IGHV1-8)
ARVIPDYYDSSGSPHDYYYYGMDV

SEQ ID NO: 591 - protein, 9 aa, Homo sapiens
  Light chain CDR3 for antibody 296 (IGKV1-6)
LQDYNYPWT

SEQ ID NO: 592 - protein, 22 aa, Homo sapiens
  Heavy chain CDR3 for antibody 296 (IGHV1-46)
AREGGLRVYDSSGYDTGYAFDI

SEQ ID NO: 593 - protein, 10 aa, Homo sapiens
  Light chain CDR3 for antibody 297 (IGKV1-9)
QQLDTYPGPT

SEQ ID NO: 594 - protein, 11 aa, Homo sapiens
  Heavy chain CDR3 for antibody 297 (IGHV3-53)
ARDLQVYGMDV

SEQ ID NO: 595 - protein, 9 aa, Homo sapiens
  Light chain CDR3 for antibody 298 (IGKV3-20)
QQYGSSPLT

SEQ ID NO: 596 - protein, 18 aa, Homo sapiens
  Heavy chain CDR3 for antibody 298 (IGHV4-34)
ARGDIVGFPYYYYYGMDV

SEQ ID NO: 597 - protein, 10 aa, Homo sapiens
  Light chain CDR3 for antibody 299 (IGKV3-11)
QQRSNWPRAT

SEQ ID NO: 598 - protein, 10 aa, Homo sapiens
  Heavy chain CDR3 for antibody 299 (IGHV3-30)
ARDLRSYYDY

SEQ ID NO: 599 - protein, 9 aa, Homo sapiens
  Light chain CDR3 for antibody 300 (IGKV1-6)
LQDYNYPWT

SEQ ID NO: 600 - protein, 12 aa, Homo sapiens
  Heavy chain CDR3 for antibody 300 (IGHV2-70)
ARGVEYYYYMDV

SEQ ID NO: 601 - protein, 8 aa, Homo sapiens
  Light chain CDR3 for antibody 301 (IGKV3-11)
QQRSNWFT

SEQ ID NO: 602 - protein, 17 aa, Homo sapiens
  Heavy chain CDR3 for antibody 301 (IGHV1-2)
ARAGAAGTRYYSYSMDV

SEQ ID NO: 603 - protein, 8 aa, Homo sapiens
  Light chain CDR3 for antibody 302 (IGKV3-11)
QQRSNWFT

SEQ ID NO: 604 - protein, 17 aa, Homo sapiens
  Heavy chain CDR3 for antibody 302 (IGHV4-59)
ARSPRGWLEQQPGYFDY

SEQ ID NO: 605 - protein, 10 aa, Homo sapiens
  Light chain CDR3 for antibody 303 (IGKV3-11)
QQRSNWPPYT

SEQ ID NO: 606 - protein, 14 aa, Homo sapiens
  Heavy chain CDR3 for antibody 303 (IGHV1-69)
ASLGDTDSFDAFDI

SEQ ID NO: 607 - protein, 10 aa, Homo sapiens
  Light chain CDR3 for antibody 304 (IGKV1-33)
QQYDNLPSLT

SEQ ID NO: 608 - protein, 10 aa, Homo sapiens
  Heavy chain CDR3 for antibody 304 (IGHV3-66)
ARDLRSYYDY

SEQ ID NO: 609 - protein, 9 aa, Homo sapiens
  Light chain CDR3 for antibody 305 (IGKV1-33)
QQYDNLPPA

SEQ ID NO: 610 - protein, 17 aa, Homo sapiens
  Heavy chain CDR3 for antibody 305 (IGHV1-2)
AREPSISRDGYSGYDDY

SEQ ID NO: 611 - protein, 11 aa, Homo sapiens
  Light chain CDR3 for antibody 306 (IGKV1-12)
QQANSFPPLFT

SEQ ID NO: 612 - protein, 17 aa, Homo sapiens
  Heavy chain CDR3 for antibody 306 (IGHV1-2)
AREPSISRDGYSGYDDY

SEQ ID NO: 613 - protein, 9 aa, Homo sapiens
  Light chain CDR3 for antibody 307 (IGKV1-33)
QQYDNLPIT

SEQ ID NO: 614 - protein, 11 aa, Homo sapiens
  Heavy chain CDR3 for antibody 307 (IGHV3-66)
ARETMVYGMDV

SEQ ID NO: 615 - protein, 9 aa, Homo sapiens
  Light chain CDR3 for antibody 308 (IGKV1-39)
QQSYSTPFT

SEQ ID NO: 616 - protein, 13 aa, Homo sapiens
  Heavy chain CDR3 for antibody 308 (IGHV4-31)
ARDYGGNSAQFGY

SEQ ID NO: 617 - protein, 8 aa, Homo sapiens
  Light chain CDR3 for antibody 309 (IGKV2D-28)
MQALQTPT

SEQ ID NO: 618 - protein, 11 aa, Homo sapiens
  Heavy chain CDR3 for antibody 309 (IGHV1-69)
ARDLGPYGMDV

SEQ ID NO: 619 - protein, 9 aa, Homo sapiens
  Light chain CDR3 for antibody 310 (IGKV2D-28)
MQALQTPYT

SEQ ID NO: 620 - protein, 22 aa, Homo sapiens
  Heavy chain CDR3 for antibody 310 (IGHV1-46)
AREGGLRVYDSSGYDTGYAFDI

SEQ ID NO: 621 - protein, 8 aa, Homo sapiens
  Light chain CDR3 for antibody 311 (IGKV3-11)
QQRSNWFT

SEQ ID NO: 622 - protein, 20 aa, Homo sapiens
  Heavy chain CDR3 for antibody 311 (IGHV3-13)
ARVGYYYDSSGLKHYWYFDL

SEQ ID NO: 623 - protein, 8 aa, Homo sapiens
  Light chain CDR3 for antibody 312 (IGKV2D-28)
MQALQTPT

SEQ ID NO: 624 - protein, 16 aa, Homo sapiens
  Heavy chain CDR3 for antibody 312 (IGHV1-18)
ARANPGAVGYYYGMDV

SEQ ID NO: 625 - protein, 11 aa, Homo sapiens
  Light chain CDR3 for antibody 313 (IGKV1-12)
QQANSFPPLFT

SEQ ID NO: 626 - protein, 9 aa, Homo sapiens
  Heavy chain CDR3 for antibody 313 (IGHV3-53)
ARESYGMDV

SEQ ID NO: 627 - protein, 9 aa, Homo sapiens
  Light chain CDR3 for antibody 314 (IGKV1-9)
QQLNSYPQA

SEQ ID NO: 628 - protein, 18 aa, Homo sapiens
  Heavy chain CDR3 for antibody 314 (IGHV3-30)
AKDGSWYYDSSGYPVFDY

SEQ ID NO: 629 - protein, 8 aa, Homo sapiens
  Light chain CDR3 for antibody 315 (IGKV3-11)
QQRSNWFT

SEQ ID NO: 630 - protein, 17 aa, Homo sapiens
  Heavy chain CDR3 for antibody 315 (IGHV1-2)
ARAGAAGTPYCDYYMDV

SEQ ID NO: 631 - protein, 10 aa, Homo sapiens
  Light chain CDR3 for antibody 316 (IGKV1-9)
QQLNSYPGPT

SEQ ID NO: 632 - protein, 12 aa, Homo sapiens
  Heavy chain CDR3 for antibody 316 (IGHV3-66)
TRDLSEAGDFDY

SEQ ID NO: 633 - protein, 9 aa, Homo sapiens
  Light chain CDR3 for antibody 317 (IGKV1-9)
QQLNSYSYT

SEQ ID NO: 634 - protein, 12 aa, Homo sapiens
  Heavy chain CDR3 for antibody 317 (IGHV3-53)
ARDLEEQGAFDI

SEQ ID NO: 635 - protein, 9 aa, Homo sapiens
  Light chain CDR3 for antibody 318 (IGKV1-39)
QQSYSTPPT

SEQ ID NO: 636 - protein, 17 aa, Homo sapiens
  Heavy chain CDR3 for antibody 318 (IGHV1-2)
AREPSISRDGYSGYDDY

SEQ ID NO: 637 - protein, 8 aa, Homo sapiens
  Light chain CDR3 for antibody 319 (IGKV2D-28)
MQALQTPT

SEQ ID NO: 638 - protein, 17 aa, Homo sapiens
  Heavy chain CDR3 for antibody 319 (IGHV4-59)
ARSPRGWLEQQPGYFDY

SEQ ID NO: 639 - protein, 9 aa, Homo sapiens
  Light chain CDR3 for antibody 320 (IGKV1-6)
LQDYNYPWT

SEQ ID NO: 640 - protein, 18 aa, Homo sapiens
  Heavy chain CDR3 for antibody 320 (IGHV2-5)
APYSGYSYGCPRAYGMDV

SEQ ID NO: 641 - protein, 10 aa, Homo sapiens
  Light chain CDR3 for antibody 321 (IGKV3-20)
QHYGSAPPWT

SEQ ID NO: 642 - protein, 12 aa, Homo sapiens
  Heavy chain CDR3 for antibody 321 (IGHV2-70)
ARNSGGYFHVDH

SEQ ID NO: 643 - protein, 10 aa, Homo sapiens
  Light chain CDR3 for antibody 322 (IGKV1-39)
QQSYSTPPLT

SEQ ID NO: 644 - protein, 12 aa, Homo sapiens
  Heavy chain CDR3 for antibody 322 (IGHV3-13)
ARDLEEQGAFDI

SEQ ID NO: 645 - protein, 9 aa, Homo sapiens
  Light chain CDR3 for antibody 323 (IGKV1-9)
QQLTSYSYT

SEQ ID NO: 646 - protein, 11 aa, Homo sapiens
  Heavy chain CDR3 for antibody 323 (IGHV3-53)
ARDLQVYGMDV

SEQ ID NO: 647 - protein, 9 aa, Homo sapiens
  Light chain CDR3 for antibody 324 (IGKV3-20)
QQYGSSLYT

SEQ ID NO: 648 - protein, 23 aa, Homo sapiens
  Heavy chain CDR3 for antibody 324 (IGHV1-2)
ARMPRPGWSPSWFGETDHRPLDY

SEQ ID NO: 649 - protein, 8 aa, Homo sapiens
  Light chain CDR3 for antibody 325 (IGKV2D-28)
MQALQTPT

SEQ ID NO: 650 - protein, 16 aa, Homo sapiens
  Heavy chain CDR3 for antibody 325 (IGHV4-34)
ARGCSGGSCYPNPFDY

SEQ ID NO: 651 - protein, 9 aa, Homo sapiens
  Light chain CDR3 for antibody 326 (IGKV1-39)
QQSYSTPPT

SEQ ID NO: 652 - protein, 11 aa, Homo sapiens
  Heavy chain CDR3 for antibody 326 (IGHV3-33)
ARDLQVYGMDV

SEQ ID NO: 653 - protein, 9 aa, Homo sapiens
  Light chain CDR3 for antibody 327 (IGKV1-9)
QQLNSYPVA

SEQ ID NO: 654 - protein, 11 aa, Homo sapiens
  Heavy chain CDR3 for antibody 327 (IGHV3-66)
ARWAWTPIFDY

SEQ ID NO: 655 - protein, 10 aa, Homo sapiens
  Light chain CDR3 for antibody 328 (IGKV1-9)
QQLDTYPGPT

SEQ ID NO: 656 - protein, 17 aa, Homo sapiens
  Heavy chain CDR3 for antibody 328 (IGHV1-2)
ARAGAAGTPYYYYYMDV

SEQ ID NO: 657 - protein, 9 aa, Homo sapiens
  Light chain CDR3 for antibody 329 (IGKV1-9)
QQLNSYSYT

SEQ ID NO: 658 - protein, 16 aa, Homo sapiens
  Heavy chain CDR3 for antibody 329 (IGHV1-18)
ARANPGAVGYYYGMDV

SEQ ID NO: 659 - protein, 9 aa, Homo sapiens
  Light chain CDR3 for antibody 330 (IGKV1-9)
QQLNSYPVA

SEQ ID NO: 660 - protein, 17 aa, Homo sapiens
  Heavy chain CDR3 for antibody 330 (IGHV1-69)
ARHSSDGDYYYYYGMDV

SEQ ID NO: 661 - protein, 10 aa, Homo sapiens
  Light chain CDR3 for antibody 331 (IGKV1-9)
QQLNSYPGPT

SEQ ID NO: 662 - protein, 12 aa, Homo sapiens
  Heavy chain CDR3 for antibody 331 (IGHV3-66)
TRDLSAAGGFDY

SEQ ID NO: 663 - protein, 10 aa, Homo sapiens
  Light chain CDR3 for antibody 332 (IGKV1-9)
QQVNSYPGPT

SEQ ID NO: 664 - protein, 17 aa, Homo sapiens
  Heavy chain CDR3 for antibody 332 (IGHV4-59)
ARSPRGWLEQQPGYFDY

SEQ ID NO: 665 - protein, 8 aa, Homo sapiens
  Light chain CDR3 for antibody 333 (IGKV3-11)
QQRSNWFT

SEQ ID NO: 666 - protein, 17 aa, Homo sapiens
  Heavy chain CDR3 for antibody 333 (IGHV1-2)
ARAGAAGTPCYCYYMDV

SEQ ID NO: 667 - protein, 8 aa, Homo sapiens
  Light chain CDR3 for antibody 334 (IGKV3-11)
QQRSNWFT

SEQ ID NO: 668 - protein, 13 aa, Homo sapiens
  Heavy chain CDR3 for antibody 334 (IGHV4-31)
ARDYGGNANYFDY

SEQ ID NO: 669 - protein, 9 aa, Homo sapiens
  Light chain CDR3 for antibody 335 (IGKV1-39)
QQSYSTPVT

SEQ ID NO: 670 - protein, 14 aa, Homo sapiens
  Heavy chain CDR3 for antibody 335 (IGHV1-24)
ATEYAVAGSWKFDY

SEQ ID NO: 671 - protein, 11 aa, Homo sapiens
  Light chain CDR3 for antibody 336 (IGKV1-12)
QQANSFPPLFT

SEQ ID NO: 672 - protein, 16 aa, Homo sapiens
  Heavy chain CDR3 for antibody 336 (IGHV3-33)
AREVDTAMDRTILWDY

SEQ ID NO: 673 - protein, 9 aa, Homo sapiens
  Light chain CDR3 for antibody 337 (IGKV1-6)
LQDYNYPWT

SEQ ID NO: 674 - protein, 17 aa, Homo sapiens
  Heavy chain CDR3 for antibody 337 (IGHV4-59)
ARSPRGWLEQQPGYFDY

SEQ ID NO: 675 - protein, 10 aa, Homo sapiens
  Light chain CDR3 for antibody 338 (IGKV1-9)
QQLNSYPGPT

SEQ ID NO: 676 - protein, 14 aa, Homo sapiens
  Heavy chain CDR3 for antibody 338 (IGHV3-23)
AKALAAAGYDAFDI

SEQ ID NO: 677 - protein, 9 aa, Homo sapiens
  Light chain CDR3 for antibody 339 (IGKV1-9)
QQLNSYSYT

SEQ ID NO: 678 - protein, 17 aa, Homo sapiens
  Heavy chain CDR3 for antibody 339 (IGHV4-59)
ARSPRGWLEQQPGYFDY

SEQ ID NO: 679 - protein, 9 aa, Homo sapiens
  Light chain CDR3 for antibody 340 (IGKV1-6)
LQDYNYPWT

SEQ ID NO: 680 - protein, 18 aa, Homo sapiens
  Heavy chain CDR3 for antibody 340 (IGHV2-26)
ADYRGYSDGYPRAYGMDV

SEQ ID NO: 681 - protein, 10 aa, Homo sapiens
  Light chain CDR3 for antibody 341 (IGKV3-20)
QQYGSSPPYT

SEQ ID NO: 682 - protein, 12 aa, Homo sapiens
  Heavy chain CDR3 for antibody 341 (IGHV3-66)
ARDLEEQGAFDI

SEQ ID NO: 683 - protein, 10 aa, Homo sapiens
  Light chain CDR3 for antibody 342 (IGKV3-11)
QQRSNWPRAT

SEQ ID NO: 684 - protein, 11 aa, Homo sapiens
  Heavy chain CDR3 for antibody 342 (IGHV3-53)
ARDLQVYGMDV

SEQ ID NO: 685 - protein, 10 aa, Homo sapiens
  Light chain CDR3 for antibody 343 (IGKV1-33)
QQYDNLPSLT

SEQ ID NO: 686 - protein, 11 aa, Homo sapiens
  Heavy chain CDR3 for antibody 343 (IGHV3-66)
ARDLQVYGMDV

SEQ ID NO: 687 - protein, 10 aa, Homo sapiens
  Light chain CDR3 for antibody 344 (IGKV4-1)
QQYYSTPLYT

SEQ ID NO: 688 - protein, 17 aa, Homo sapiens
  Heavy chain CDR3 for antibody 344 (IGHV1-2)
ARAGAAGTPYYYYYMDV

SEQ ID NO: 689 - protein, 8 aa, Homo sapiens
  Light chain CDR3 for antibody 345 (IGKV3-11)
QQRSNWFT

SEQ ID NO: 690 - protein, 18 aa, Homo sapiens
  Heavy chain CDR3 for antibody 345 (IGHV1-2)
AKDGSWYYDSSGYPVFDY

SEQ ID NO: 691 - protein, 10 aa, Homo sapiens [sequence omitted]

SEQ ID NO: 692 - protein, 16 aa, Homo sapiens
  Heavy chain CDR3 for antibody 346 (IGHV4-34)
ARGCSGGSCYPNPFDY

SEQ ID NO: 693 - protein, 8 aa, Homo sapiens
  Light chain CDR3 for antibody 347 (IGKV3-20)
QQYGSSPT

SEQ ID NO: 694 - protein, 24 aa, Homo sapiens
  Heavy chain CDR3 for antibody 347 (IGHV1-46)
AGPITMVRGVIIPDYYYYYYGMDV

SEQ ID NO: 695 - protein, 9 aa, Homo sapiens
  Light chain CDR3 for antibody 348 (IGKV1-6)
LQDYNYPWT

SEQ ID NO: 696 - protein, 12 aa, Homo sapiens
  Heavy chain CDR3 for antibody 348 (IGHV3-66)
ARDLEEQGAFDI

SEQ ID NO: 697 - protein, 9 aa, Homo sapiens
  Light chain CDR3 for antibody 349 (IGKV1-12)
QQANSFPLT

SEQ ID NO: 698 - protein, 17 aa, Homo sapiens
  Heavy chain CDR3 for antibody 349 (IGHV4-31)
ARTSENILRFLEGEFDP

SEQ ID NO: 699 - protein, 9 aa, Homo sapiens
  Light chain CDR3 for antibody 350 (IGKV1-39)
QQSYSTPPT

SEQ ID NO: 700 - protein, 9 aa, Homo sapiens
  Heavy chain CDR3 for antibody 350 (IGHV3-53)
ARESYGMDV

SEQ ID NO: 701 - protein, 10 aa, Homo sapiens
  Light chain CDR3 for antibody 351 (IGKV1-9)
HQLSSYPGPT

SEQ ID NO: 702 - protein, 12 aa, Homo sapiens
  Heavy chain CDR3 for antibody 351 (IGHV3-66)
ARDLSEAGGFDY

SEQ ID NO: 703 - protein, 9 aa, Homo sapiens
  Light chain CDR3 for antibody 352 (IGKV2D-28)
MQALQTPYT

SEQ ID NO: 704 - protein, 17 aa, Homo sapiens
  Heavy chain CDR3 for antibody 352 (IGHV1-69)
ARHSSDGDYYYYYGMDV

SEQ ID NO: 705 - protein, 8 aa, Homo sapiens
  Light chain CDR3 for antibody 353 (IGKV2D-28)
MQALQTPT

SEQ ID NO: 706 - protein, 17 aa, Homo sapiens
  Heavy chain CDR3 for antibody 353 (IGHV4/OR15-8)
ARDLTDYGDHGGYWFDP

SEQ ID NO: 707 - protein, 9 aa, Homo sapiens
  Light chain CDR3 for antibody 354 (IGKV1-6)
LQDYNYPWT

SEQ ID NO: 708 - protein, 17 aa, Homo sapiens
  Heavy chain CDR3 for antibody 354 (IGHV4/OR15-8)
ARDLTDYGDHGGYWFDP

SEQ ID NO: 709 - protein, 9 aa, Homo sapiens
  Light chain CDR3 for antibody 355 (IGKV1-13)
QQANGFPYT

SEQ ID NO: 710 - protein, 20 aa, Homo sapiens
  Heavy chain CDR3 for antibody 355 (IGHV1-2)
ARGGQIEDVWGSYREYYFDY

SEQ ID NO: 711 - protein, 9 aa, Homo sapiens
  Light chain CDR3 for antibody 356 (IGKV1-39)
QRTDSVPHS

SEQ ID NO: 712 - protein, 12 aa, Homo sapiens
  Heavy chain CDR3 for antibody 356 (IGHV3-66)
ARDLSAAGGFDY

SEQ ID NO: 713 - protein, 10 aa, Homo sapiens
  Light chain CDR3 for antibody 357 (IGKV1-9)
QQVNSYPGPT

SEQ ID NO: 714 - protein, 16 aa, Homo sapiens
  Heavy chain CDR3 for antibody 357 (IGHV3-53)
ARANPGAVGYYYGMDV

SEQ ID NO: 715 - protein, 10 aa, Homo sapiens
  Light chain CDR3 for antibody 358 (IGKV1-9)
QQVNSYPGPT

SEQ ID NO: 716 - protein, 11 aa, Homo sapiens
  Heavy chain CDR3 for antibody 358 (IGHV4-31)
ARWSSSGSFDY

SEQ ID NO: 717 - protein, 11 aa, Homo sapiens
  Light chain CDR3 for antibody 359 (IGKV3-15)
QQYNNWPPMYT

SEQ ID NO: 718 - protein, 10 aa, Homo sapiens
  Heavy chain CDR3 for antibody 359 (IGHV3-66)
ARDLRSYYDY

SEQ ID NO: 719 - protein, 10 aa, Homo sapiens [sequence omitted]

SEQ ID NO: 720 - protein, 16 aa, Homo sapiens
  Heavy chain CDR3 for antibody 360 (IGHV4-61)
ARDGSYSSSWKNWFDP

SEQ ID NO: 721 - protein, 10 aa, Homo sapiens
  Light chain CDR3 for antibody 361 (IGKV1-9)
QQVNSYPGPT

SEQ ID NO: 722 - protein, 12 aa, Homo sapiens
  Heavy chain CDR3 for antibody 361 (IGHV3-53)
ARDLGSVGATDY

SEQ ID NO: 723 - protein, 9 aa, Homo sapiens
  Light chain CDR3 for antibody 362 (IGKV1-6)
LQDYNYPWT

SEQ ID NO: 724 - protein, 18 aa, Homo sapiens
  Heavy chain CDR3 for antibody 362 (IGHV2-5)
ADYSGYSYGYQGAYGMDV

SEQ ID NO: 725 - protein, 9 aa, Homo sapiens
  Light chain CDR3 for antibody 363 (IGKV1-9)
QQLNSYSYT

SEQ ID NO: 726 - protein, 17 aa, Homo sapiens
  Heavy chain CDR3 for antibody 363 (IGHV1-2)
ARAGAAGTPYYYYYMDV

SEQ ID NO: 727 - protein, 9 aa, Homo sapiens
  Light chain CDR3 for antibody 364 (IGKV1-33)
QQYDNLPYS

SEQ ID NO: 728 - protein, 17 aa, Homo sapiens
  Heavy chain CDR3 for antibody 364 (IGHV1-3)
ATEYCSGGSCYWSAFDY

SEQ ID NO: 729 - protein, 9 aa, Homo sapiens
  Light chain CDR3 for antibody 365 (IGKV3-20)
QQYGSSLYT

SEQ ID NO: 730 - protein, 10 aa, Homo sapiens
  Heavy chain CDR3 for antibody 365 (IGHV3-66)
ARDLRSYYDY

SEQ ID NO: 731 - protein, 8 aa, Homo sapiens
  Light chain CDR3 for antibody 366 (IGKV3-11)
QQRSNWFT

SEQ ID NO: 732 - protein, 17 aa, Homo sapiens
  Heavy chain CDR3 for antibody 366 (IGHV1-69)
ARQPWGSSSDYYYYMDV

SEQ ID NO: 733 - protein, 9 aa, Homo sapiens
  Light chain CDR3 for antibody 367 (IGKV1-27)
QKYNSAPWT

SEQ ID NO: 734 - protein, 18 aa, Homo sapiens
  Heavy chain CDR3 for antibody 367 (IGHV2-70)
AHYSGYSYGYPRAYGMDV

SEQ ID NO: 735 - protein, 9 aa, Homo sapiens
  Light chain CDR3 for antibody 368 (IGKV1-39)
QQSHTFPLT

SEQ ID NO: 736 - protein, 10 aa, Homo sapiens
  Heavy chain CDR3 for antibody 368 (IGHV3-66)
ARDLRSYYDY

SEQ ID NO: 737 - protein, 10 aa, Homo sapiens
  Light chain CDR3 for antibody 369 (IGKV3-11)
QQRSNWPRAT

SEQ ID NO: 738 - protein, 12 aa, Homo sapiens
  Heavy chain CDR3 for antibody 369 (IGHV3-66)
ARDLEEQGAFDI

SEQ ID NO: 739 - protein, 9 aa, Homo sapiens
  Light chain CDR3 for antibody 370 (IGKV1-6)
LQDYNYPWT

SEQ ID NO: 740 - protein, 16 aa, Homo sapiens
  Heavy chain CDR3 for antibody 370 (IGHV3-33)
AREVDTAMDRTILWDY

SEQ ID NO: 741 - protein, 10 aa, Homo sapiens
  Light chain CDR3 for antibody 371 (IGKV1-9)
QQVNSYPGPT

SEQ ID NO: 742 - protein, 11 aa, Homo sapiens
  Heavy chain CDR3 for antibody 371 (IGHV3-53)
ARDKWEGAFDI

SEQ ID NO: 743 - protein, 10 aa, Homo sapiens
  Light chain CDR3 for antibody 372 (IGKV3-20)
QQYGSSPPYT

SEQ ID NO: 744 - protein, 17 aa, Homo sapiens
  Heavy chain CDR3 for antibody 372 (IGHV1-2)
ARAGAAGTPYYYYYMDV

SEQ ID NO: 745 - protein, 9 aa, Homo sapiens
  Light chain CDR3 for antibody 373 (IGKV1-33)
QQYDNLPLT

SEQ ID NO: 746 - protein, 16 aa, Homo sapiens
  Heavy chain CDR3 for antibody 373 (IGHV4-34)
ARGCSGGSCYPNPFDY

SEQ ID NO: 747 - protein, 10 aa, Homo sapiens
  Light chain CDR3 for antibody 374 (IGKV1-33)
QQYDNLPWRS

SEQ ID NO: 748 - protein, 10 aa, Homo sapiens
  Heavy chain CDR3 for antibody 374 (IGHV3-66)
ARDLRSYYDY

SEQ ID NO: 749 - protein, 10 aa, Homo sapiens
  Light chain CDR3 for antibody 375 (IGKV1-9)
QQVNSYPGPT

SEQ ID NO: 750 - protein, 19 aa, Homo sapiens
  Heavy chain CDR3 for antibody 375 (IGHV1-69)
ARAHRSSTSYRLGINWFDP

SEQ ID NO: 751 - protein, 9 aa, Homo sapiens
  Light chain CDR3 for antibody 376 (IGKV1-33)
QQYDNLPPT

SEQ ID NO: 752 - protein, 16 aa, Homo sapiens
  Heavy chain CDR3 for antibody 376 (IGHV3-33)
AREVDTAMDRTILWDY

SEQ ID NO: 753 - protein, 8 aa, Homo sapiens
  Light chain CDR3 for antibody 377 (IGKV3-11)
QQRSNWFT

SEQ ID NO: 754 - protein, 19 aa, Homo sapiens
  Heavy chain CDR3 for antibody 377 (IGHV1-69)
ARAHRSSASYRLGINWFDP

SEQ ID NO: 755 - protein, 8 aa, Homo sapiens
  Light chain CDR3 for antibody 378 (IGKV1-33)
QQYDNLPS

SEQ ID NO: 756 - protein, 18 aa, Homo sapiens
  Heavy chain CDR3 for antibody 378 (IGHV1-69)
ARGAGIVGAIGRHSFFNY

SEQ ID NO: 757 - protein, 10 aa, Homo sapiens
  Light chain CDR3 for antibody 379 (IGKV1-9)
QQLNSYPGPT

SEQ ID NO: 758 - protein, 9 aa, Homo sapiens
  Heavy chain CDR3 for antibody 379 (IGHV4-30-2)
TRGGHYTDP

SEQ ID NO: 759 - protein, 8 aa, Homo sapiens
  Light chain CDR3 for antibody 380 (IGKV3-11)
QQRSNWFT

SEQ ID NO: 760 - protein, 17 aa, Homo sapiens
  Heavy chain CDR3 for antibody 380 (IGHV1-2)
ARAGAAGTADYYYYMED

SEQ ID NO: 761 - protein, 10 aa, Homo sapiens [sequence omitted]

SEQ ID NO: 762 - protein, 13 aa, Homo sapiens
  Heavy chain CDR3 for antibody 381 (IGHV4-31)
ARDYGGNSAQSGY

SEQ ID NO: 763 - protein, 9 aa, Homo sapiens
  Light chain CDR3 for antibody 382 (IGKV1-12)
QQANSFPPT

SEQ ID NO: 764 - protein, 22 aa, Homo sapiens
  Heavy chain CDR3 for antibody 382 (IGHV1-46)
AREGGLRVYDSSGYDTGYAFDI

SEQ ID NO: 765 - protein, 9 aa, Homo sapiens
  Light chain CDR3 for antibody 383 (IGKV1-6)
LQDYNYPWT

SEQ ID NO: 766 - protein, 18 aa, Homo sapiens
  Heavy chain CDR3 for antibody 383 (IGHV2-26)
AHYSGYSYGFPRSYGMDA

SEQ ID NO: 767 - protein, 8 aa, Homo sapiens
  Light chain CDR3 for antibody 384 (IGKV2D-28)
MQALQTPT

SEQ ID NO: 768 - protein, 16 aa, Homo sapiens
  Heavy chain CDR3 for antibody 384 (IGHV3-33)
AREVDTAMDRTIRWDY

SEQ ID NO: 769 - protein, 10 aa, Homo sapiens
  Light chain CDR3 for antibody 385 (IGKV3D-15)
QQYNNLPPWT

SEQ ID NO: 770 - protein, 17 aa, Homo sapiens
  Heavy chain CDR3 for antibody 385 (IGHV1-2)
ARETAISRDGYSGYDDY

SEQ ID NO: 771 - protein, 9 aa, Homo sapiens
  Light chain CDR3 for antibody 386 (IGKV1-6)
LQDYNYPWT

SEQ ID NO: 772 - protein, 18 aa, Homo sapiens
  Heavy chain CDR3 for antibody 386 (IGHV2-5)
AHYSGYSYGYQRSYGMGV

SEQ ID NO: 773 - protein, 10 aa, Homo sapiens
  Light chain CDR3 for antibody 387 (IGKV2-30)
MQGTHWPPPS

SEQ ID NO: 774 - protein, 12 aa, Homo sapiens
  Heavy chain CDR3 for antibody 387 (IGHV3-66)
ARDLSAAGGFDY

SEQ ID NO: 775 - protein, 10 aa, Homo sapiens
  Light chain CDR3 for antibody 388 (IGKV1-39)
QQSYGSPRFT

SEQ ID NO: 776 - protein, 18 aa, Homo sapiens
  Heavy chain CDR3 for antibody 388 (IGHV2-5)
AHYSGYSYGYPRAYGMDV

SEQ ID NO: 777 - protein, 8 aa, Homo sapiens
  Light chain CDR3 for antibody 389 (IGKV3-11)
QQRSNWFT

SEQ ID NO: 778 - protein, 17 aa, Homo sapiens
  Heavy chain CDR3 for antibody 389 (IGHV1-2)
ARAVADCTPYHYYCMDV

SEQ ID NO: 779 - protein, 9 aa, Homo sapiens
  Light chain CDR3 for antibody 390 (IGKV3-20)
QQYASSPIT

SEQ ID NO: 780 - protein, 11 aa, Homo sapiens
  Heavy chain CDR3 for antibody 390 (IGHV3-53)
ARDLQVYGMDV

SEQ ID NO: 781 - protein, 10 aa, Homo sapiens
  Light chain CDR3 for antibody 391 (IGKV1-9)
QQVNSYPAPT

SEQ ID NO: 782 - protein, 12 aa, Homo sapiens
  Heavy chain CDR3 for antibody 391 (IGHV3-66)
ARELSAAGGFDY

SEQ ID NO: 783 - protein, 10 aa, Homo sapiens
  Light chain CDR3 for antibody 392 (IGKV1-33)
QQYDNLPPLT

SEQ ID NO: 784 - protein, 11 aa, Homo sapiens
  Heavy chain CDR3 for antibody 392 (IGHV6-1)
ARETMVYGMDV

SEQ ID NO: 785 - protein, 10 aa, Homo sapiens [sequence omitted]

SEQ ID NO: 786 - protein, 17 aa, Homo sapiens
  Heavy chain CDR3 for antibody 393 (IGHV1-69)
ARGAEGIVVERGQPFDF

SEQ ID NO: 787 - protein, 10 aa, Homo sapiens
  Light chain CDR3 for antibody 394 (IGKV3-NL1)
QQYGSSPPYT

SEQ ID NO: 788 - protein, 17 aa, Homo sapiens
  Heavy chain CDR3 for antibody 394 (IGHV1-2)
AREPSISRDGYSGYDDY

SEQ ID NO: 789 - protein, 9 aa, Homo sapiens
  Light chain CDR3 for antibody 395 (IGKV1-17)
LQHNSYPRT

SEQ ID NO: 790 - protein, 10 aa, Homo sapiens
  Heavy chain CDR3 for antibody 395 (IGHV3-66)
ARDLRSYYDY

SEQ ID NO: 791 - protein, 8 aa, Homo sapiens
  Light chain CDR3 for antibody 396 (IGKV3-11)
QQRSNWFT

SEQ ID NO: 792 - protein, 14 aa, Homo sapiens
  Heavy chain CDR3 for antibody 396 (IGHV3-h)
ARIDYYDSSGYPDY

SEQ ID NO: 793 - protein, 7 aa, Homo sapiens
  Light chain CDR3 for antibody 397 (IGKV1D-12)
QQANSFT

SEQ ID NO: 794 - protein, 12 aa, Homo sapiens
  Heavy chain CDR3 for antibody 397 (IGHV3-66)
ARDLEEQGAFDI

SEQ ID NO: 795 - protein, 11 aa, Homo sapiens
  Light chain CDR3 for antibody 398 (IGKV1-33)
QQYDNLPPLYS

SEQ ID NO: 796 - protein, 12 aa, Homo sapiens
  Heavy chain CDR3 for antibody 398 (IGHV3-53)
ARDLSAAGGFDY

SEQ ID NO: 797 - protein, 10 aa, Homo sapiens
  Light chain CDR3 for antibody 399 (IGKV1-9)
QQLNSYPGPT

SEQ ID NO: 798 - protein, 17 aa, Homo sapiens
  Heavy chain CDR3 for antibody 399 (IGHV3-66)
ARDVYCSSTSCTDAFDI

SEQ ID NO: 799 - protein, 9 aa, Homo sapiens
  Light chain CDR3 for antibody 400 (IGKV1-6)
LQDYNYPWT

SEQ ID NO: 800 - protein, 18 aa, Homo sapiens
  Heavy chain CDR3 for antibody 400 (IGHV2-70)
AHDSGYSYCYPRAYGMDV

SEQ ID NO: 801 - protein, 9 aa, Homo sapiens
  Light chain CDR3 for antibody 401 (IGKV1-6)
LQDYNYPWT

SEQ ID NO: 802 - protein, 18 aa, Homo sapiens
  Heavy chain CDR3 for antibody 401 (IGHV2-5)
ARYSGYSDGYPRAYGMDV

SEQ ID NO: 803 - protein, 10 aa, Homo sapiens
  Light chain CDR3 for antibody 402 (IGKV3-11)
QQRSNWPPFT

SEQ ID NO: 804 - protein, 14 aa, Homo sapiens
  Heavy chain CDR3 for antibody 402 (IGHV5-a)
AIWRGIFYYYGMDV

SEQ ID NO: 805 - protein, 9 aa, Homo sapiens
  Light chain CDR3 for antibody 403 (IGKV3-20)
QQYGSSLYT

SEQ ID NO: 806 - protein, 22 aa, Homo sapiens
  Heavy chain CDR3 for antibody 403 (IGHV1-46)
AREGGIRVYDSSGYDTGYAFDI

SEQ ID NO: 807 - protein, 9 aa, Homo sapiens
  Light chain CDR3 for antibody 404 (IGKV3-20)
QQYDSSPIT

SEQ ID NO: 808 - protein, 10 aa, Homo sapiens
  Heavy chain CDR3 for antibody 404 (IGHV3-21)
ARDLRSYYDY

SEQ ID NO: 809 - protein, 10 aa, Homo sapiens [sequence omitted]

SEQ ID NO: 810 - protein, 15 aa, Homo sapiens
  Heavy chain CDR3 for antibody 405 (IGHV1-2)
ARDIVVVPAAMGLDY

SEQ ID NO: 811 - protein, 11 aa, Homo sapiens
  Light chain CDR3 for antibody 406 (IGKV3-15)
QQYNNLPPMYT

SEQ ID NO: 812 - protein, 17 aa, Homo sapiens
  Heavy chain CDR3 for antibody 406 (IGHV1-2)
ARAGAAGTPYYYYYMDV

SEQ ID NO: 813 - protein, 11 aa, Homo sapiens
  Light chain CDR3 for antibody 407 (IGKV1-12)
QQANSFPPQFT

SEQ ID NO: 814 - protein, 17 aa, Homo sapiens
  Heavy chain CDR3 for antibody 407 (IGHV4/OR15-8)
ARDLTDYGDHGGYWFDP

SEQ ID NO: 815 - protein, 10 aa, Homo sapiens
  Light chain CDR3 for antibody 408 (IGKV1-33)
QQYDNLLLLT

SEQ ID NO: 816 - protein, 23 aa, Homo sapiens
  Heavy chain CDR3 for antibody 408 (IGHV4-31)
ARMPRPGWSPSWFGETDHRPLDY

SEQ ID NO: 817 - protein, 10 aa, Homo sapiens
  Light chain CDR3 for antibody 409 (IGKV1-9)
QQLNSYPGPT

SEQ ID NO: 818 - protein, 12 aa, Homo sapiens
  Heavy chain CDR3 for antibody 409 (IGHV5-51)
ARQGYYGDYFDS

SEQ ID NO: 819 - protein, 9 aa, Homo sapiens
  Light chain CDR3 for antibody 410 (IGKV1-6)
LQDYNYPWT

SEQ ID NO: 820 - protein, 18 aa, Homo sapiens
  Heavy chain CDR3 for antibody 410 (IGHV2-5)
ARYSGCSYGYPRAYGMGV

SEQ ID NO: 821 - protein, 9 aa, Homo sapiens
  Light chain CDR3 for antibody 411 (IGKV3-20)
QQYGSSPYT

SEQ ID NO: 822 - protein, 17 aa, Homo sapiens
  Heavy chain CDR3 for antibody 411 (IGHV1-69)
ARHSSDGDYYYYYGMDV

SEQ ID NO: 823 - protein, 10 aa, Homo sapiens
  Light chain CDR3 for antibody 412 (IGKV3-11)
QQRSNWPPAT

SEQ ID NO: 824 - protein, 18 aa, Homo sapiens
  Heavy chain CDR3 for antibody 412 (IGHV2-5)
AHYSGYSYGYPRAYGMDV

SEQ ID NO: 825 - protein, 9 aa, Homo sapiens
  Light chain CDR3 for antibody 413 (IGKV1-9)
QQLNSYPPA

SEQ ID NO: 826 - protein, 9 aa, Homo sapiens
  Heavy chain CDR3 for antibody 413 (IGHV4-30-2)
TRGGHYTDP

SEQ ID NO: 827 - protein, 10 aa, Homo sapiens
  Light chain CDR3 for antibody 414 (IGKV1-9)
QQLNSYPGPT

SEQ ID NO: 828 - protein, 12 aa, Homo sapiens
  Heavy chain CDR3 for antibody 414 (IGHV3-66)
AIDLSESGGFDY

SEQ ID NO: 829 - protein, 8 aa, Homo sapiens
  Light chain CDR3 for antibody 415 (IGKV3-11)
QQRSNWFT

SEQ ID NO: 830 - protein, 17 aa, Homo sapiens
  Heavy chain CDR3 for antibody 415 (IGHV1-2)
ARARAAGTPYDYYYMDV

SEQ ID NO: 831 - protein, 9 aa, Homo sapiens
  Light chain CDR3 for antibody 416 (IGKV1-6)
LQDYNYPWT

SEQ ID NO: 832 - protein, 18 aa, Homo sapiens
  Heavy chain CDR3 for antibody 416 (IGHV2-5)
AHYSGYSYGFPRDYGMGV

SEQ ID NO: 833 - protein, 8 aa, Homo sapiens
  Light chain CDR3 for antibody 417 (IGKV3-11)
QQRSNWFT

SEQ ID NO: 834 - protein, 17 aa, Homo sapiens
  Heavy chain CDR3 for antibody 417 (IGHV1-2)
ARADAASTPYYYYYIDV

SEQ ID NO: 835 - protein, 9 aa, Homo sapiens
  Light chain CDR3 for antibody 418 (IGKV1-6)
LQDYNYPWT

SEQ ID NO: 836 - protein, 11 aa, Homo sapiens
  Heavy chain CDR3 for antibody 418 (IGHV3-53)
ARDGRGDLWYY

SEQ ID NO: 837 - protein, 10 aa, Homo sapiens
  Light chain CDR3 for antibody 419 (IGKV1-9)
QQLNSYPGPT

SEQ ID NO: 838 - protein, 16 aa, Homo sapiens
  Heavy chain CDR3 for antibody 419 (IGHV1-69)
ARDHSGSYYYYYGMDV

SEQ ID NO: 839 - protein, 10 aa, Homo sapiens
  Light chain CDR3 for antibody 420 (IGKV1-33)
QQYDNLPSLT

SEQ ID NO: 840 - protein, 19 aa, Homo sapiens
  Heavy chain CDR3 for antibody 420 (IGHV4-31)
ARAPSITHFVARVVDAFDI

SEQ ID NO: 841 - protein, 11 aa, Homo sapiens
  Light chain CDR3 for antibody 421 (IGKV1D-12)
QQANSFPPLFT

SEQ ID NO: 842 - protein, 20 aa, Homo sapiens
  Heavy chain CDR3 for antibody 421 (IGHV2-26)
ARTTYYYDSSGYYPLNYFDY

SEQ ID NO: 843 - protein, 9 aa, Homo sapiens
  Light chain CDR3 for antibody 422 (IGKV1-12)
QQANSFPYS

SEQ ID NO: 844 - protein, 13 aa, Homo sapiens
  Heavy chain CDR3 for antibody 422 (IGHV4-31)
ARDYGGNSAQFGY

SEQ ID NO: 845 - protein, 9 aa, Homo sapiens
  Light chain CDR3 for antibody 423 (IGKV1-33)
QQYDNLPLT

SEQ ID NO: 846 - protein, 10 aa, Homo sapiens
  Heavy chain CDR3 for antibody 423 (IGHV3-66)
ARDLRSYYEY

SEQ ID NO: 847 - protein, 10 aa, Homo sapiens
  Light chain CDR3 for antibody 424 (IGKV2-30)
MQGTHWPPPP

SEQ ID NO: 848 - protein, 17 aa, Homo sapiens
  Heavy chain CDR3 for antibody 424 (IGHV1-69)
ARAGAAGTPYYYYYMDV

SEQ ID NO: 849 - protein, 10 aa, Homo sapiens
  Light chain CDR3 for antibody 425 (IGKV1-9)
QQVNSYPGPT

SEQ ID NO: 850 - protein, 12 aa, Homo sapiens
  Heavy chain CDR3 for antibody 425 (IGHV4-59)
ARGAGRYSHLDY

SEQ ID NO: 851 - protein, 9 aa, Homo sapiens
  Light chain CDR3 for antibody 426 (IGKV1-9)
QQLNSYPPS

SEQ ID NO: 852 - protein, 17 aa, Homo sapiens
  Heavy chain CDR3 for antibody 426 (IGHV1-2)
ARAGAAGAPYYYYCMDV

SEQ ID NO: 853 - protein, 9 aa, Homo sapiens
  Light chain CDR3 for antibody 427 (IGKV1-33)
QQYDNLPIT

SEQ ID NO: 854 - protein, 23 aa, Homo sapiens
  Heavy chain CDR3 for antibody 427 (IGHV1-2)
ARMPRPGWSPSWFGEADHRPLDY

SEQ ID NO: 855 - protein, 9 aa, Homo sapiens
  Light chain CDR3 for antibody 428 (IGKV1-6)
LQDYNYPWT

SEQ ID NO: 856 - protein, 18 aa, Homo sapiens
  Heavy chain CDR3 for antibody 428 (IGHV2-5)
AHYSGYSYGCARAYGMYV

SEQ ID NO: 857 - protein, 9 aa, Homo sapiens
  Light chain CDR3 for antibody 429 (IGKV1-9)
QQLNSYPPS

SEQ ID NO: 858 - protein, 22 aa, Homo sapiens
  Heavy chain CDR3 for antibody 429 (IGHV1-46)
ASEGGTRVYDSSGYDTGYGFDI

SEQ ID NO: 859 - protein, 10 aa, Homo sapiens
  Light chain CDR3 for antibody 430 (IGKV1-33)
QQYDNLPSLT

SEQ ID NO: 860 - protein, 16 aa, Homo sapiens
  Heavy chain CDR3 for antibody 430 (IGHV4-34)
ARGCSGGSCYPNPFDY

SEQ ID NO: 861 - protein, 8 aa, Homo sapiens
  Light chain CDR3 for antibody 431 (IGKV2D-28)
MQALQTPT

SEQ ID NO: 862 - protein, 17 aa, Homo sapiens
  Heavy chain CDR3 for antibody 431 (IGHV1-18)
ARGLRWCGADCYYGMDV

SEQ ID NO: 863 - protein, 9 aa, Homo sapiens
  Light chain CDR3 for antibody 432 (IGKV1-12)
QQYNTSPFT

SEQ ID NO: 864 - protein, 12 aa, Homo sapiens
  Heavy chain CDR3 for antibody 432 (IGHV3-66)
ARDLSEAGGFDY

SEQ ID NO: 865 - protein, 10 aa, Homo sapiens
  Light chain CDR3 for antibody 433 (IGKV1-9)
QQVNSYPGPT

SEQ ID NO: 866 - protein, 9 aa, Homo sapiens
  Heavy chain CDR3 for antibody 433 (IGHV4/OR15-8)
ARVLGAMCT

SEQ ID NO: 867 - protein, 8 aa, Homo sapiens
  Light chain CDR3 for antibody 434 (IGKV3-11)
QQRSNWFT

SEQ ID NO: 868 - protein, 17 aa, Homo sapiens
  Heavy chain CDR3 for antibody 434 (IGHV4/OR15-8)
ARDLTDYGDHGGYWFDP

SEQ ID NO: 869 - protein, 10 aa, Homo sapiens
  Light chain CDR3 for antibody 435 (IGKV3-11)
QQRSNWPPAT

SEQ ID NO: 870 - protein, 17 aa, Homo sapiens
  Heavy chain CDR3 for antibody 435 (IGHV1-2)
AREPSISRDGYSGYDDY

SEQ ID NO: 871 - protein, 10 aa, Homo sapiens
  Light chain CDR3 for antibody 436 (IGKV1-9)
QQLNSYPRPT

SEQ ID NO: 872 - protein, 12 aa, Homo sapiens
  Heavy chain CDR3 for antibody 436 (IGHV3-66)
ARDLSEAGGFDS

SEQ ID NO: 873 - protein, 9 aa, Homo sapiens
  Light chain CDR3 for antibody 437 (IGKV1-9)
QQLNSYPVA

SEQ ID NO: 874 - protein, 10 aa, Homo sapiens
  Heavy chain CDR3 for antibody 437 (IGHV3-66)
ARDLRNYFSY

SEQ ID NO: 875 - protein, 9 aa, Homo sapiens
  Light chain CDR3 for antibody 438 (IGKV1-9)
QQLNIDRDT

SEQ ID NO: 876 - protein, 19 aa, Homo sapiens
  Heavy chain CDR3 for antibody 438 (IGHV4-31)
ARCTTTTQWLKMVVNWFDP

SEQ ID NO: 877 - protein, 10 aa, Homo sapiens
  Light chain CDR3 for antibody 439 (IGKV3-11)
QQRSNWPPYS

SEQ ID NO: 878 - protein, 17 aa, Homo sapiens
  Heavy chain CDR3 for antibody 439 (IGHV1-69)
ARGLLWFGADYYYGMDV

SEQ ID NO: 879 - protein, 10 aa, Homo sapiens
  Light chain CDR3 for antibody 440 (IGKV1-13)
QQLNSYPGPT

SEQ ID NO: 880 - protein, 12 aa, Homo sapiens
  Heavy chain CDR3 for antibody 440 (IGHV2-70)
ARGVEYYYYMDV

SEQ ID NO: 881 - protein, 9 aa, Homo sapiens
  Light chain CDR3 for antibody 441 (IGKV1-9)
QQLNSYPVA

SEQ ID NO: 882 - protein, 17 aa, Homo sapiens
  Heavy chain CDR3 for antibody 441 (IGHV1-69)
ARGLLWFGAEYYYGMDV

SEQ ID NO: 883 - protein, 9 aa, Homo sapiens
  Light chain CDR3 for antibody 442 (IGKV1-9)
QQLNSYPPA

SEQ ID NO: 884 - protein, 16 aa, Homo sapiens
  Heavy chain CDR3 for antibody 442 (IGHV3-53)
ARANPGAVGYYYGMDV

SEQ ID NO: 885 - protein, 9 aa, Homo sapiens
  Light chain CDR3 for antibody 443 (IGKV1-6)
LQDYNYPWT

SEQ ID NO: 886 - protein, 18 aa, Homo sapiens
  Heavy chain CDR3 for antibody 443 (IGHV2-5)
ADYSGSSYGHPRAYGMDV

SEQ ID NO: 887 - protein, 9 aa, Homo sapiens
  Light chain CDR3 for antibody 444 (IGKV1-6)
LQDYNYPWT

SEQ ID NO: 888 - protein, 11 aa, Homo sapiens
  Heavy chain CDR3 for antibody 444 (IGHV3-66)
ARETMVYGMDV

SEQ ID NO: 889 - protein, 8 aa, Homo sapiens
  Light chain CDR3 for antibody 445 (IGKV3-11)
QQRSNWFT

SEQ ID NO: 890 - protein, 17 aa, Homo sapiens
  Heavy chain CDR3 for antibody 445 (IGHV1-2)
ARAGAAGTPCCYYYMDA

SEQ ID NO: 891 - protein, 9 aa, Homo sapiens
  Light chain CDR3 for antibody 446 (IGKV1-17)
LQHNSYPRT

SEQ ID NO: 892 - protein, 17 aa, Homo sapiens
  Heavy chain CDR3 for antibody 446 (IGHV4/OR15-8)
ARDLTDYGDHGGYWFDP

SEQ ID NO: 893 - protein, 8 aa, Homo sapiens
  Light chain CDR3 for antibody 447 (IGKV2D-28)
MQALQTPT

SEQ ID NO: 894 - protein, 14 aa, Homo sapiens
  Heavy chain CDR3 for antibody 447 (IGHV1-69)
AKNEASALLAWFDP

SEQ ID NO: 895 - protein, 9 aa, Homo sapiens
  Light chain CDR3 for antibody 448 (IGKV2D-28)
MQALQTPPT

SEQ ID NO: 896 - protein, 10 aa, Homo sapiens
  Heavy chain CDR3 for antibody 448 (IGHV3-66)
ARDLRSYYDY

SEQ ID NO: 897 - protein, 10 aa, Homo sapiens [sequence omitted]

SEQ ID NO: 898 - protein, 15 aa, Homo sapiens
  Heavy chain CDR3 for antibody 449 (IGHV4-34)
ARARRMVYVIDAFDI

SEQ ID NO: 899 - protein, 10 aa, Homo sapiens
  Light chain CDR3 for antibody 450 (IGKV1-9)
QQLDSYPGPT

SEQ ID NO: 900 - protein, 16 aa, Homo sapiens
  Heavy chain CDR3 for antibody 450 (IGHV1-69)
ARVEWGDFDYYYGMDV

SEQ ID NO: 901 - protein, 8 aa, Homo sapiens
  Light chain CDR3 for antibody 451 (IGKV3-11)
QQRSNWFT

SEQ ID NO: 902 - protein, 18 aa, Homo sapiens
  Heavy chain CDR3 for antibody 451 (IGHV1-69)
ARGEWEPLSYYYYYYMDV

SEQ ID NO: 903 - protein, 9 aa, Homo sapiens
  Light chain CDR3 for antibody 452 (IGKV1-39)
QQSHTFPLT

SEQ ID NO: 904 - protein, 12 aa, Homo sapiens
  Heavy chain CDR3 for antibody 452 (IGHV3-66)
ARDLSAAGGFDY

SEQ ID NO: 905 - protein, 9 aa, Homo sapiens
  Light chain CDR3 for antibody 453 (IGKV1-6)
LQDYNYPWT

SEQ ID NO: 906 - protein, 17 aa, Homo sapiens
  Heavy chain CDR3 for antibody 453 (IGHV1-69)
ARHSSDGDYYYYYGMDV

SEQ ID NO: 907 - protein, 9 aa, Homo sapiens
  Light chain CDR3 for antibody 454 (IGKV1-27)
QKYNSAPLT

SEQ ID NO: 908 - protein, 12 aa, Homo sapiens
  Heavy chain CDR3 for antibody 454 (IGHV1-69)
ARDLEEQGAFDI

SEQ ID NO: 909 - protein, 10 aa, Homo sapiens
  Light chain CDR3 for antibody 455 (IGKV1-9)
QQLDTYPGPT

SEQ ID NO: 910 - protein, 9 aa, Homo sapiens
  Heavy chain CDR3 for antibody 455 (IGHV3-53)
ARESYGMDV

SEQ ID NO: 911 - protein, 11 aa, Homo sapiens
  Light chain CDR3 for antibody 456 (IGKV1-12)
QQANSFPPQFT

SEQ ID NO: 912 - protein, 12 aa, Homo sapiens
  Heavy chain CDR3 for antibody 456 (IGHV3-66)
ARYLEKQGAFDI

SEQ ID NO: 913 - protein, 10 aa, Homo sapiens
  Light chain CDR3 for antibody 457 (IGKV1-9)
QQLNSYPGPT

SEQ ID NO: 914 - protein, 10 aa, Homo sapiens
  Heavy chain CDR3 for antibody 457 (IGHV3-66)
ARELRSYSDY

SEQ ID NO: 915 - protein, 9 aa, Homo sapiens
  Light chain CDR3 for antibody 458 (IGKV1-33)
QQYDNLPLT

SEQ ID NO: 916 - protein, 11 aa, Homo sapiens
  Heavy chain CDR3 for antibody 458 (IGHV3-53)
ARDLGPYGMDV

SEQ ID NO: 917 - protein, 10 aa, Homo sapiens [sequence omitted]

SEQ ID NO: 918 - protein, 18 aa, Homo sapiens
  Heavy chain CDR3 for antibody 459 (IGHV3-30)
AKDGSWYYDSSGYPVFDY

SEQ ID NO: 919 - protein, 11 aa, Homo sapiens
  Light chain CDR3 for antibody 460 (IGKV3-20)
QQYGGSPPNFT

SEQ ID NO: 920 - protein, 16 aa, Homo sapiens
  Heavy chain CDR3 for antibody 460 (IGHV1-24)
ATASPIAVAGNNWFDP

SEQ ID NO: 921 - protein, 9 aa, Homo sapiens
  Light chain CDR3 for antibody 461 (IGKV1D-12)
QQANSFPLT

SEQ ID NO: 922 - protein, 16 aa, Homo sapiens
  Heavy chain CDR3 for antibody 461 (IGHV4-31)
ARASAIFGVVIREFDY

SEQ ID NO: 923 - protein, 9 aa, Homo sapiens
  Light chain CDR3 for antibody 462 (IGKV3-11)
QQRSNWPRT

SEQ ID NO: 924 - protein, 14 aa, Homo sapiens
  Heavy chain CDR3 for antibody 462 (IGHV3-53)
AREWWARDGYYMDV

SEQ ID NO: 925 - protein, 10 aa, Homo sapiens
  Light chain CDR3 for antibody 463 (IGKV1-33)
QQYDNLPWRS

SEQ ID NO: 926 - protein, 11 aa, Homo sapiens
  Heavy chain CDR3 for antibody 463 (IGHV3-53)
ARDLGPYGMDV

SEQ ID NO: 927 - protein, 10 aa, Homo sapiens
  Light chain CDR3 for antibody 464 (IGKV1-9)
QQLDTYPGPT

SEQ ID NO: 928 - protein, 11 aa, Homo sapiens
  Heavy chain CDR3 for antibody 464 (IGHV3-66)
ARETMVYGMDV

SEQ ID NO: 929 - protein, 9 aa, Homo sapiens
  Light chain CDR3 for antibody 465 (IGKV1-9)
QQLNSYPPA

SEQ ID NO: 930 - protein, 19 aa, Homo sapiens
  Heavy chain CDR3 for antibody 465 (IGHV1-69)
ARAHRSSTSYRLGINWFDP

SEQ ID NO: 931 - protein, 9 aa, Homo sapiens
  Light chain CDR3 for antibody 466 (IGKV1-9)
QQLNSYPVA

SEQ ID NO: 932 - protein, 10 aa, Homo sapiens
  Heavy chain CDR3 for antibody 466 (IGHV3-66)
ARDLRRYFDY

SEQ ID NO: 933 - protein, 10 aa, Homo sapiens
  Light chain CDR3 for antibody 467 (IGKV1-9)
QQLDTYPGPT

SEQ ID NO: 934 - protein, 12 aa, Homo sapiens
  Heavy chain CDR3 for antibody 467 (IGHV3-66)
ARDLEEQGAFDI

SEQ ID NO: 935 - protein, 10 aa, Homo sapiens
  Light chain CDR3 for antibody 468 (IGKV1-9)
QQLNSYPGPT

SEQ ID NO: 936 - protein, 11 aa, Homo sapiens
  Heavy chain CDR3 for antibody 468 (IGHV3-30)
ARDWAIHSFDY

SEQ ID NO: 937 - protein, 9 aa, Homo sapiens
  Light chain CDR3 for antibody 469 (IGKV1-6)
LQDYNYPWT

SEQ ID NO: 938 - protein, 18 aa, Homo sapiens
  Heavy chain CDR3 for antibody 469 (IGHV2-5)
AHYSGYRYGSPRAYGMDV

SEQ ID NO: 939 - protein, 10 aa, Homo sapiens
  Light chain CDR3 for antibody 470 (IGKV1-9)
QQLNSYPSIT

SEQ ID NO: 940 - protein, 10 aa, Homo sapiens
  Heavy chain CDR3 for antibody 470 (IGHV3-66)
ARDLRSYYDY

SEQ ID NO: 941 - protein, 9 aa, Homo sapiens
  Light chain CDR3 for antibody 471 (IGKV1-9)
QQLNSYPVA

SEQ ID NO: 942 - protein, 20 aa, Homo sapiens
  Heavy chain CDR3 for antibody 471 (IGHV3-NL1)
AKQLGQYCSGGSCYSGYFDY

SEQ ID NO: 943 - protein, 9 aa, Homo sapiens
  Light chain CDR3 for antibody 472 (IGKV1-6)
LQDYNYPWT

SEQ ID NO: 944 - protein, 23 aa, Homo sapiens
  Heavy chain CDR3 for antibody 472 (IGHV1-2)
ARMPRPGWSPSWFGETDHRPLDY

SEQ ID NO: 945 - protein, 10 aa, Homo sapiens
  Light chain CDR3 for antibody 473 (IGKV1-9)
QQLNSYPGPT

SEQ ID NO: 946 - protein, 16 aa, Homo sapiens
  Heavy chain CDR3 for antibody 473 (IGHV4-61)
ARDGSYSSSWKNWFDP

SEQ ID NO: 947 - protein, 9 aa, Homo sapiens
  Light chain CDR3 for antibody 474 (IGKV1-6)
LQDYNYPWT

SEQ ID NO: 948 - protein, 16 aa, Homo sapiens
  Heavy chain CDR3 for antibody 474 (IGHV4-34)
ARGCSGGSCYPNPFDY

SEQ ID NO: 949 - protein, 10 aa, Homo sapiens
  Light chain CDR3 for antibody 475 (IGKV4-1)
QQYYSTPLYT

SEQ ID NO: 950 - protein, 17 aa, Homo sapiens
  Heavy chain CDR3 for antibody 475 (IGHV1-2)
AREPSISRDGYSGYDDY

SEQ ID NO: 951 - protein, 10 aa, Homo sapiens [sequence omitted]

SEQ ID NO: 952 - protein, 16 aa, Homo sapiens
  Heavy chain CDR3 for antibody 476 (IGHV1-2)
ARAGAAGTPYYYYMDV

SEQ ID NO: 953 - protein, 8 aa, Homo sapiens
  Light chain CDR3 for antibody 477 (IGKV3-11)
QQRSNWFT

SEQ ID NO: 954 - protein, 20 aa, Homo sapiens
  Heavy chain CDR3 for antibody 477 (IGHV4-39)
ARTGHLIRFLEWLPITWFDP

SEQ ID NO: 955 - protein, 8 aa, Homo sapiens
  Light chain CDR3 for antibody 478 (IGKV2D-28)
MQALQTPT

SEQ ID NO: 956 - protein, 9 aa, Homo sapiens
  Heavy chain CDR3 for antibody 478 (IGHV3-53)
ARESYGMDV

SEQ ID NO: 957 - protein, 9 aa, Homo sapiens
  Light chain CDR3 for antibody 479 (IGKV1-6)
LQDYNYPWT

SEQ ID NO: 958 - protein, 12 aa, Homo sapiens
  Heavy chain CDR3 for antibody 479 (IGHV3-53)
ARDLGSVGATDY

SEQ ID NO: 959 - protein, 8 aa, Homo sapiens
  Light chain CDR3 for antibody 480 (IGKV3-11)
QQRSNWFT

SEQ ID NO: 960 - protein, 16 aa, Homo sapiens
  Heavy chain CDR3 for antibody 480 (IGHV1-69)
ARDHSGSYYYYYGMDV

SEQ ID NO: 961 - protein, 9 aa, Homo sapiens
  Light chain CDR3 for antibody 481 (IGKV1-9)
QQLNSYPVA

SEQ ID NO: 962 - protein, 10 aa, Homo sapiens
  Heavy chain CDR3 for antibody 481 (IGHV3-30)
ARDLRSYFDF

SEQ ID NO: 963 - protein, 9 aa, Homo sapiens
  Light chain CDR3 for antibody 482 (IGKV1-17)
LQHNSYPRT

SEQ ID NO: 964 - protein, 11 aa, Homo sapiens
  Heavy chain CDR3 for antibody 482 (IGHV3-66)
ARDLQVYGMDV

SEQ ID NO: 965 - protein, 8 aa, Homo sapiens
  Light chain CDR3 for antibody 483 (IGKV3-11)
QQRSNWFT

SEQ ID NO: 966 - protein, 14 aa, Homo sapiens
  Heavy chain CDR3 for antibody 483 (IGHV1-69)
AKNEASALLAWFDP

SEQ ID NO: 967 - protein, 8 aa, Homo sapiens
  Light chain CDR3 for antibody 484 (IGKV1-6)
QDCNYPWT

SEQ ID NO: 968 - protein, 18 aa, Homo sapiens
  Heavy chain CDR3 for antibody 484 (IGHV2-5)
AHYSGYSYGYPRAYGMDV

SEQ ID NO: 969 - protein, 10 aa, Homo sapiens
  Light chain CDR3 for antibody 485 (IGKV3-11)
QQRSNWPPYT

SEQ ID NO: 970 - protein, 11 aa, Homo sapiens
  Heavy chain CDR3 for antibody 485 (IGHV1-69)
AGWFGESEFDY

SEQ ID NO: 971 - protein, 10 aa, Homo sapiens
  Light chain CDR3 for antibody 486 (IGKV1-33)
QQYDNLLLLT

SEQ ID NO: 972 - protein, 18 aa, Homo sapiens
  Heavy chain CDR3 for antibody 486 (IGHV2-5)
AHYSGYSYGYPRAYGMDV

SEQ ID NO: 973 - protein, 9 aa, Homo sapiens
  Light chain CDR3 for antibody 487 (IGKV1-6)
LQDYNYPWT

SEQ ID NO: 974 - protein, 19 aa, Homo sapiens
  Heavy chain CDR3 for antibody 487 (IGHV4-31)
ARCTTTTQWLKMVVNWFDP

SEQ ID NO: 975 - protein, 8 aa, Homo sapiens
  Light chain CDR3 for antibody 488 (IGKV3-11)
QQRSNWFT

SEQ ID NO: 976 - protein, 13 aa, Homo sapiens
  Heavy chain CDR3 for antibody 488 (IGHV4-31)
ARDYGGNSAQFGY

SEQ ID NO: 977 - protein, 8 aa, Homo sapiens
  Light chain CDR3 for antibody 489 (IGKV1-33)
QQYDNLPG

SEQ ID NO: 978 - protein, 17 aa, Homo sapiens
  Heavy chain CDR3 for antibody 489 (IGHV1-69)
ARGLLWFGADYYYGMDV

SEQ ID NO: 979 - protein, 8 aa, Homo sapiens
  Light chain CDR3 for antibody 490 (IGKV1-5)
QQYNSYST

SEQ ID NO: 980 - protein, 16 aa, Homo sapiens
  Heavy chain CDR3 for antibody 490 (IGHV3-53)
AKWARGGDVDYYGMDV

SEQ ID NO: 981 - protein, 10 aa, Homo sapiens [sequence omitted]

SEQ ID NO: 982 - protein, 17 aa, Homo sapiens
  Heavy chain CDR3 for antibody 491 (IGHV4-59)
ARSPRGWLEQQPGYFDY

SEQ ID NO: 983 - protein, 8 aa, Homo sapiens
  Light chain CDR3 for antibody 492 (IGKV3-11)
QQRSNWFT

SEQ ID NO: 984 - protein, 15 aa, Homo sapiens
  Heavy chain CDR3 for antibody 492 (IGHV1-46)
ARDIVVVPAAMGLDY

SEQ ID NO: 985 - protein, 10 aa, Homo sapiens
  Light chain CDR3 for antibody 493 (IGKV1-39)
QQSYSTPPIT

SEQ ID NO: 986 - protein, 13 aa, Homo sapiens
  Heavy chain CDR3 for antibody 493 (IGHV3-53)
ARERGDTAMAVGD

SEQ ID NO: 987 - protein, 9 aa, Homo sapiens
  Light chain CDR3 for antibody 494 (IGKV1-33)
QQYDNLPLT

SEQ ID NO: 988 - protein, 19 aa, Homo sapiens
  Heavy chain CDR3 for antibody 494 (IGHV1-69)
ARDRLRIQLSPHYYYYMDV

SEQ ID NO: 989 - protein, 9 aa, Homo sapiens
  Light chain CDR3 for antibody 495 (IGKV1-12)
QEADGFPWA

SEQ ID NO: 990 - protein, 14 aa, Homo sapiens
  Heavy chain CDR3 for antibody 495 (IGHV3-30)
AKEATKRASRHFDF

SEQ ID NO: 991 - protein, 10 aa, Homo sapiens
  Light chain CDR3 for antibody 496 (IGKV3-20)
QQYGSSPPDT

SEQ ID NO: 992 - protein, 13 aa, Homo sapiens
  Heavy chain CDR3 for antibody 496 (IGHV5-51)
ARRYSGFHAELDY

SEQ ID NO: 993 - protein, 9 aa, Homo sapiens
  Light chain CDR3 for antibody 497 (IGKV1-33)
QQYDNLPIT

SEQ ID NO: 994 - protein, 14 aa, Homo sapiens
  Heavy chain CDR3 for antibody 497 (IGHV3-53)
ARIGSGYYYYGMDV

SEQ ID NO: 995 - protein, 9 aa, Homo sapiens
  Light chain CDR3 for antibody 498 (IGKV1-39)
QQSYSTPKT

SEQ ID NO: 996 - protein, 12 aa, Homo sapiens
  Heavy chain CDR3 for antibody 498 (IGHV3-64)
ASLAGYSGYYDY

SEQ ID NO: 997 - protein, 9 aa, Homo sapiens
  Light chain CDR3 for antibody 499 (IGKV3-20)
QQYGSSPET

SEQ ID NO: 998 - protein, 13 aa, Homo sapiens
  Heavy chain CDR3 for antibody 499 (IGHV1-69)
ARFPNAALRAFDI

SEQ ID NO: 999 - protein, 9 aa, Homo sapiens
  Light chain CDR3 for antibody 500 (IGKV1-12)
QQGNSFPPA

SEQ ID NO: 1000 - protein, 11 aa, Homo sapiens
  Heavy chain CDR3 for antibody 500 (IGHV4-30-2)
ARGTKVVTFDS

SEQ ID NO: 1001 - protein, 9 aa, Homo sapiens
  Light chain CDR3 for antibody 501 (IGKV1-27)
QKYNSAPLT

SEQ ID NO: 1002 - protein, 9 aa, Homo sapiens
  Heavy chain CDR3 for antibody 501 (IGHV4-61)
VRGRGRTTT

SEQ ID NO: 1003 - protein, 9 aa, Homo sapiens
  Light chain CDR3 for antibody 502 (IGKV1-33)
QQYDNLPLT

SEQ ID NO: 1004 - protein, 13 aa, Homo sapiens
  Heavy chain CDR3 for antibody 502 (IGHV3-53)
ARERGDTAMAVGD

SEQ ID NO: 1005 - protein, 9 aa, Homo sapiens
  Light chain CDR3 for antibody 503 (IGKV3-11)
QQRSDWPPT

SEQ ID NO: 1006 - protein, 16 aa, Homo sapiens
  Heavy chain CDR3 for antibody 503 (IGHV4-39)
VRPTMNTEGGVHWFDP

SEQ ID NO: 1007 - protein, 9 aa, Homo sapiens
  Light chain CDR3 for antibody 504 (IGKV1D-12)
QQGDSFPLT

SEQ ID NO: 1008 - protein, 13 aa, Homo sapiens
  Heavy chain CDR3 for antibody 504 (IGHV3-74)
VRDQYGENFYMDV

SEQ ID NO: 1009 - protein, 10 aa, Homo sapiens
  Light chain CDR3 for antibody 505 (IGKV1-39)
QQSYSTPPWT

SEQ ID NO: 1010 - protein, 18 aa, Homo sapiens
  Heavy chain CDR3 for antibody 505 (IGHV3-13)
ARGVSSSWGYYYYYYMDV

SEQ ID NO: 1011 - protein, 10 aa, Homo sapiens
  Light chain CDR3 for antibody 506 (IGKV2-30)
MQGTHWPPWT

SEQ ID NO: 1012 - protein, 12 aa, Homo sapiens
  Heavy chain CDR3 for antibody 506 (IGHV3-15)
TTSVGGNSGVDC

SEQ ID NO: 1013 - protein, 10 aa, Homo sapiens
  Light chain CDR3 for antibody 507 (IGKV1-39)
QQSYSTPPIT

SEQ ID NO: 1014 - protein, 19 aa, Homo sapiens
  Heavy chain CDR3 for antibody 507 (IGHV1-69)
ARDRLRIQLSPHYYYYMDV

SEQ ID NO: 1015 - protein, 9 aa, Homo sapiens
  Light chain CDR3 for antibody 508 (IGKV3-20)
HQYGSTPWT

SEQ ID NO: 1016 - protein, 18 aa, Homo sapiens
  Heavy chain CDR3 for antibody 508 (IGHV4-4)
ARGEAADEVGHHYGALDY

SEQ ID NO: 1017 - protein, 9 aa, Homo sapiens
  Light chain CDR3 for antibody 509 (IGKV3-20)
QQCAHAPLT

SEQ ID NO: 1018 - protein, 10 aa, Homo sapiens
  Heavy chain CDR3 for antibody 509 (IGHV4-39)
AGGAGWTADH

SEQ ID NO: 1019 - protein, 9 aa, Homo sapiens
  Light chain CDR3 for antibody 510 (IGKV3-20)
QQYGSSSWT

SEQ ID NO: 1020 - protein, 9 aa, Homo sapiens
  Heavy chain CDR3 for antibody 510 (IGHV3-11)
ARGNYGMDV

SEQ ID NO: 1021 - protein, 9 aa, Homo sapiens
  Light chain CDR3 for antibody 511 (IGKV1-12)
QEADGFPWA

SEQ ID NO: 1022 - protein, 13 aa, Homo sapiens
  Heavy chain CDR3 for antibody 511 (IGHV3-53)
ARERGDTAMAVGD

SEQ ID NO: 1023 - protein, 10 aa, Homo sapiens
  Light chain CDR3 for antibody 512 (IGKV1-39)
QQSYSTPPIT

SEQ ID NO: 1024 - protein, 11 aa, Homo sapiens
  Heavy chain CDR3 for antibody 512 (IGHV3-53)
ARDLGPYGMDV

SEQ ID NO: 1025 - protein, 9 aa, Homo sapiens
  Light chain CDR3 for antibody 513 (IGKV1-NL1)
QQYYSTPWT

SEQ ID NO: 1026 - protein, 11 aa, Homo sapiens
  Heavy chain CDR3 for antibody 513 (IGHV3-53)
ARDLQVYGMDV

SEQ ID NO: 1027 - protein, 10 aa, Homo sapiens
  Light chain CDR3 for antibody 514 (IGKV1-39)
QQSYSTPPIT

SEQ ID NO: 1028 - protein, 14 aa, Homo sapiens
  Heavy chain CDR3 for antibody 514 (IGHV3-30)
AKEATKRASRHFDF

SEQ ID NO: 1029 - protein, 9 aa, Homo sapiens
  Light chain CDR3 for antibody 515 (IGKV1-39)
QQYDSYSLT

SEQ ID NO: 1030 - protein, 15 aa, Homo sapiens
  Heavy chain CDR3 for antibody 515 (IGHV1-2)
ARGEIQTLRSMPSDY

SEQ ID NO: 1031 - protein, 10 aa, Homo sapiens
  Light chain CDR3 for antibody 516 (IGKV2-30)
VQGTHRPPNT

SEQ ID NO: 1032 - protein, 10 aa, Homo sapiens
  Heavy chain CDR3 for antibody 516 (IGHV6-1)
ARDWEYSLDY

SEQ ID NO: 1033 - protein, 9 aa, Homo sapiens
  Light chain CDR3 for antibody 517 (IGKV1-39)
QQSYSTPLT

SEQ ID NO: 1034 - protein, 18 aa, Homo sapiens
  Heavy chain CDR3 for antibody 517 (IGHV3-48)
ARYSSGWYRHPLPNGMDV

SEQ ID NO: 1035 - protein, 10 aa, Homo sapiens
  Light chain CDR3 for antibody 518 (IGKV1-39)
QQSYSTPPWT

SEQ ID NO: 1036 - protein, 14 aa, Homo sapiens
  Heavy chain CDR3 for antibody 518 (IGHV1-2)
ARWWIWFGEFIMDV

SEQ ID NO: 1037 - protein, 10 aa, Homo sapiens
  Light chain CDR3 for antibody 519 (IGKV3-11)
QQRSNWPPRT

SEQ ID NO: 1038 - protein, 13 aa, Homo sapiens
  Heavy chain CDR3 for antibody 519 (IGHV1-69)
ASCTNYYYYYMYV

SEQ ID NO: 1039 - protein, 9 aa, Homo sapiens
  Light chain CDR3 for antibody 520 (IGKV1-39)
QQSHSPIWT

SEQ ID NO: 1040 - protein, 18 aa, Homo sapiens
  Heavy chain CDR3 for antibody 520 (IGHV4-30-2)
ATNVTLTGDQKRRGWFDP

SEQ ID NO: 1041 - protein, 10 aa, Homo sapiens
  Light chain CDR3 for antibody 521 (IGKV1-39)
QQSYSTPPIT

SEQ ID NO: 1042 - protein, 14 aa, Homo sapiens
  Heavy chain CDR3 for antibody 521 (IGHV3-53)
ARIGSGYYYYGMDV

SEQ ID NO: 1043 - protein, 9 aa, Homo sapiens
  Light chain CDR3 for antibody 522 (IGKV1-33)
QQYDAFPIT

SEQ ID NO: 1044 - protein, 14 aa, Homo sapiens
  Heavy chain CDR3 for antibody 522 (IGHV4-59)
ARGSTHCGGDCYHD

SEQ ID NO: 1045 - protein, 9 aa, Homo sapiens
  Light chain CDR3 for antibody 523 (IGKV1-39)
QQTYTIPFT

SEQ ID NO: 1046 - protein, 10 aa, Homo sapiens
  Heavy chain CDR3 for antibody 523 (IGHV1-58)
AAAGNGAEDY

SEQ ID NO: 1047 - protein, 8 aa, Homo sapiens
  Light chain CDR3 for antibody 524 (IGKV3-11)
QQRSNWIT

SEQ ID NO: 1048 - protein, 12 aa, Homo sapiens
  Heavy chain CDR3 for antibody 524 (IGHV1-8)
ARAGYSGSYPDY

SEQ ID NO: 1049 - protein, 9 aa, Homo sapiens
  Light chain CDR3 for antibody 525 (IGKV1-39)
QQSYSTPKT

SEQ ID NO: 1050 - protein, 13 aa, Homo sapiens
  Heavy chain CDR3 for antibody 525 (IGHV3-53)
ARERGDTAMAVGD

SEQ ID NO: 1051 - protein, 9 aa, Homo sapiens
  Light chain CDR3 for antibody 526 (IGKV1-39)
QQSYTTPHT

SEQ ID NO: 1052 - protein, 11 aa, Homo sapiens
  Heavy chain CDR3 for antibody 526 (IGHV2-5)
AHSTILVSLDY

SEQ ID NO: 1053 - protein, 8 aa, Homo sapiens
  Light chain CDR3 for antibody 527 (IGKV3-20)
QQYGSSPT

SEQ ID NO: 1054 - protein, 19 aa, Homo sapiens
  Heavy chain CDR3 for antibody 527 (IGHV1-69)
ARDRLRIQLSPHYYYYMDV

SEQ ID NO: 1055 - protein, 9 aa, Homo sapiens
  Light chain CDR3 for antibody 528 (IGKV3-11)
QQRNIWPLT

SEQ ID NO: 1056 - protein, 10 aa, Homo sapiens
  Heavy chain CDR3 for antibody 528 (IGHV4-39)
ARETESRGDY

SEQ ID NO: 1057 - protein, 9 aa, Homo sapiens
  Light chain CDR3 for antibody 529 (IGKV1-39)
QQSYSTPPT

SEQ ID NO: 1058 - protein, 14 aa, Homo sapiens
  Heavy chain CDR3 for antibody 529 (IGHV3-30)
ARSRGGNYYYGMDV

SEQ ID NO: 1059 - protein, 9 aa, Homo sapiens
  Light chain CDR3 for antibody 530 (IGKV6-21)
HQSSSLPYS

SEQ ID NO: 1060 - protein, 13 aa, Homo sapiens
  Heavy chain CDR3 for antibody 530 (IGHV1-18)
AREDGDYVVSFDY

SEQ ID NO: 1061 - protein, 9 aa, Homo sapiens
  Light chain CDR3 for antibody 531 (IGKV1-39)
QQSYTTVRT

SEQ ID NO: 1062 - protein, 18 aa, Homo sapiens
  Heavy chain CDR3 for antibody 531 (IGHV2-70)
AHESRIFGLILSHWYFDV

SEQ ID NO: 1063 - protein, 9 aa, Homo sapiens
  Light chain CDR3 for antibody 532 (IGKV3-20)
QQYGSSLYT

SEQ ID NO: 1064 - protein, 13 aa, Homo sapiens
  Heavy chain CDR3 for antibody 532 (IGHV3-53)
ARERGDTAMAVGD

SEQ ID NO: 1065 - protein, 9 aa, Homo sapiens
  Light chain CDR3 for antibody 533 (IGKV3-11)
QQRNIWPLT

SEQ ID NO: 1066 - protein, 14 aa, Homo sapiens
  Heavy chain CDR3 for antibody 533 (IGHV3-30)
AKEATKRASRHFDF

SEQ ID NO: 1067 - protein, 10 aa, Homo sapiens
  Light chain CDR3 for antibody 534 (IGKV2-30)
MQGTHWPPWT

SEQ ID NO: 1068 - protein, 10 aa, Homo sapiens
  Heavy chain CDR3 for antibody 534 (IGHV6-1)
ARDWEYSLDY

SEQ ID NO: 1069 - protein, 9 aa, Homo sapiens
  Light chain CDR3 for antibody 535 (IGKV3-20)
HQYGSTPWT

SEQ ID NO: 1070 - protein, 13 aa, Homo sapiens
  Heavy chain CDR3 for antibody 535 (IGHV1-69)
ARGSGWYPIYFDY

SEQ ID NO: 1071 - protein, 9 aa, Homo sapiens
  Light chain CDR3 for antibody 536 (IGKV2D-28)
MQALQTPIT

SEQ ID NO: 1072 - protein, 14 aa, Homo sapiens
  Heavy chain CDR3 for antibody 536 (IGHV2-5)
AHRLSAMVSSYFDY

SEQ ID NO: 1073 - protein, 9 aa, Homo sapiens
  Light chain CDR3 for antibody 537 (IGKV1-33)
QQYDNLPYT

SEQ ID NO: 1074 - protein, 12 aa, Homo sapiens
  Heavy chain CDR3 for antibody 537 (IGHV3-15)
TTSVGGNSGVDC

SEQ ID NO: 1075 - protein, 10 aa, Homo sapiens
  Light chain CDR3 for antibody 538 (IGKV1-39)
QQSYSTPPIT

SEQ ID NO: 1076 - protein, 9 aa, Homo sapiens
  Heavy chain CDR3 for antibody 538 (IGHV3-53)
ARESYGMDV

SEQ ID NO: 1077 - protein, 10 aa, Homo sapiens
  Light chain CDR3 for antibody 539 (IGKV1-39)
QQSYSTPPIT

SEQ ID NO: 1078 - protein, 13 aa, Homo sapiens
  Heavy chain CDR3 for antibody 539 (IGHV4-31)
ARDYGGNSAQFGY

SEQ ID NO: 1079 - protein, 8 aa, Homo sapiens
  Light chain CDR3 for antibody 540 (IGKV2D-28)
MQALQTIT

SEQ ID NO: 1080 - protein, 22 aa, Homo sapiens
  Heavy chain CDR3 for antibody 540 (IGHV1-2)
ARDGAGDCGGDCLEYYYYYMDV

SEQ ID NO: 1081 - protein, 9 aa, Homo sapiens
  Light chain CDR3 for antibody 541 (IGKV1-39)
QQSYSTPLT

SEQ ID NO: 1082 - protein, 12 aa, Homo sapiens
  Heavy chain CDR3 for antibody 541 (IGHV3-15)
TTSVGGNSGVDC

SEQ ID NO: 1083 - protein, 9 aa, Homo sapiens
  Light chain CDR3 for antibody 542 (IGKV1-12)
QEADGFPWA

SEQ ID NO: 1084 - protein, 16 aa, Homo sapiens
  Heavy chain CDR3 for antibody 542 (IGHV4-39)
VRPTMNTEGGVHWFDP

SEQ ID NO: 1085 - protein, 9 aa, Homo sapiens
  Light chain CDR3 for antibody 543 (IGKV1-13)
QQSYSTPYT

SEQ ID NO: 1086 - protein, 14 aa, Homo sapiens
  Heavy chain CDR3 for antibody 543 (IGHV4-59)
AGLRWPLNYYGMDV

SEQ ID NO: 1087 - protein, 10 aa, Homo sapiens
  Light chain CDR3 for antibody 544 (IGKV1-13)
QQFNSYPPLT

SEQ ID NO: 1088 - protein, 12 aa, Homo sapiens
  Heavy chain CDR3 for antibody 544 (IGHV3-33)
AKDYPGNGYWVY

SEQ ID NO: 1089 - protein, 9 aa, Homo sapiens
  Light chain CDR3 for antibody 545 (IGKV3-NL5)
HQYAHSPLT

SEQ ID NO: 1090 - protein, 10 aa, Homo sapiens
  Heavy chain CDR3 for antibody 545 (IGHV3-11)
AGGSGWLQES

SEQ ID NO: 1091 - protein, 9 aa, Homo sapiens
  Light chain CDR3 for antibody 546 (IGKV1-5)
QQYNSYPYT

SEQ ID NO: 1092 - protein, 10 aa, Homo sapiens
  Heavy chain CDR3 for antibody 546 (IGHV1-f)
ARDSFGAYDI

SEQ ID NO: 1093 - protein, 8 aa, Homo sapiens
  Light chain CDR3 for antibody 547 (IGKV1-39)
QQSYSNPT

SEQ ID NO: 1094 - protein, 10 aa, Homo sapiens
  Heavy chain CDR3 for antibody 547 (IGHV4-61)
AIGMGWLIDY

SEQ ID NO: 1095 - protein, 9 aa, Homo sapiens
  Light chain CDR3 for antibody 548 (IGKV1-13)
QQFNTYPIT

SEQ ID NO: 1096 - protein, 18 aa, Homo sapiens
  Heavy chain CDR3 for antibody 548 (IGHV2-26)
ARSMSELRLWYFYYFMDV

SEQ ID NO: 1097 - protein, 9 aa, Homo sapiens
  Light chain CDR3 for antibody 549 (IGKV3-20)
HQYAYAPLT

SEQ ID NO: 1098 - protein, 10 aa, Homo sapiens
  Heavy chain CDR3 for antibody 549 (IGHV2-5)
AHGAGWLPDY

SEQ ID NO: 1099 - protein, 9 aa, Homo sapiens
  Light chain CDR3 for antibody 550 (IGKV1-39)
QQSHITPIT

SEQ ID NO: 1100 - protein, 13 aa, Homo sapiens
  Heavy chain CDR3 for antibody 550 (IGHV3-74)
VRDQYGENFYMDV

SEQ ID NO: 1101 - protein, 9 aa, Homo sapiens
  Light chain CDR3 for antibody 551 (IGKV1-5)
QQYNSYSWT

SEQ ID NO: 1102 - protein, 19 aa, Homo sapiens
  Heavy chain CDR3 for antibody 551 (IGHV3-33)
AKDLPPWGEYSSSLGGFDY

SEQ ID NO: 1103 - protein, 10 aa, Homo sapiens
  Light chain CDR3 for antibody 552 (IGKV1-12)
QQANSFLSFT

SEQ ID NO: 1104 - protein, 18 aa, Homo sapiens
  Heavy chain CDR3 for antibody 552 (IGHV4-4)
ARGEAADEVGHHYGALDY

SEQ ID NO: 1105 - protein, 8 aa, Homo sapiens
  Light chain CDR3 for antibody 553 (IGKV3-20)
QQYGSSPT

SEQ ID NO: 1106 - protein, 13 aa, Homo sapiens
  Heavy chain CDR3 for antibody 553 (IGHV3-53)
ARERGDTAMAVGD

SEQ ID NO: 1107 - protein, 9 aa, Homo sapiens
  Light chain CDR3 for antibody 554 (IGKV1-12)
QQANSFPIT

SEQ ID NO: 1108 - protein, 22 aa, Homo sapiens
  Heavy chain CDR3 for antibody 554 (IGHV1-2)
ARDGAGDCGGDCLEYYYYYMDV

SEQ ID NO: 1109 - protein, 9 aa, Homo sapiens
  Light chain CDR3 for antibody 555 (IGKV1-17)
LQDNRYPLT

SEQ ID NO: 1110 - protein, 13 aa, Homo sapiens
  Heavy chain CDR3 for antibody 555 (IGHV3-74)
VRDQYGENFYMDV

SEQ ID NO: 1111 - protein, 10 aa, Homo sapiens
  Light chain CDR3 for antibody 556 (IGKV1-39)
QQSYSTPPIT

SEQ ID NO: 1112 - protein, 12 aa, Homo sapiens
  Heavy chain CDR3 for antibody 556 (IGHV3-64)
ASLAGYSGYYDY

SEQ ID NO: 1113 - protein, 9 aa, Homo sapiens
  Light chain CDR3 for antibody 557 (IGKV1-5)
QQYHAYSSA

SEQ ID NO: 1114 - protein, 15 aa, Homo sapiens
  Heavy chain CDR3 for antibody 557 (IGHV1-8)
ARSYRASIGTPHFDD

SEQ ID NO: 1115 - protein, 11 aa, Homo sapiens
  Light chain CDR3 for antibody 558 (IGKV3-NL5)
QQYDASPPTWT

SEQ ID NO: 1116 - protein, 17 aa, Homo sapiens
  Heavy chain CDR3 for antibody 558 (IGHV4/OR15-8)
ARGKGWFGSHFSYYMDV

SEQ ID NO: 1117 - protein, 9 aa, Homo sapiens
  Light chain CDR3 for antibody 559 (IGKV1-39)
QQSYSTPYT

SEQ ID NO: 1118 - protein, 11 aa, Homo sapiens
  Heavy chain CDR3 for antibody 559 (IGHV4-b)
ARYSGSRYFDL

SEQ ID NO: 1119 - protein, 9 aa, Homo sapiens
  Light chain CDR3 for antibody 560 (IGKV1-5)
QQYHSYPYT

SEQ ID NO: 1120 - protein, 19 aa, Homo sapiens
  Heavy chain CDR3 for antibody 560 (IGHV5-51)
ARHAAARRGLWSYFYHVDV

SEQ ID NO: 1121 - protein, 10 aa, Homo sapiens
  Light chain CDR3 for antibody 561 (IGKV2-30)
MQGTHWPPWT

SEQ ID NO: 1122 - protein, 14 aa, Homo sapiens
  Heavy chain CDR3 for antibody 561 (IGHV3-30)
AKEATKRASRHFDF

SEQ ID NO: 1123 - protein, 9 aa, Homo sapiens
  Light chain CDR3 for antibody 562 (IGKV3-20)
QQYGSSPQT

SEQ ID NO: 1124 - protein, 19 aa, Homo sapiens
  Heavy chain CDR3 for antibody 562 (IGHV6-1)
ARATLRYFDWLYHYMGFDY

SEQ ID NO: 1125 - protein, 9 aa, Homo sapiens
  Light chain CDR3 for antibody 563 (IGKV1-33)
QQYDNLPLT

SEQ ID NO: 1126 - protein, 24 aa, Homo sapiens
  Heavy chain CDR3 for antibody 563 (IGHV1-46)
AGPITMVRGVIIPDYYYYYYGMDV

SEQ ID NO: 1127 - protein, 10 aa, Homo sapiens
  Light chain CDR3 for antibody 564 (IGKV1-9)
QQLNSYPSIT

SEQ ID NO: 1128 - protein, 13 aa, Homo sapiens
  Heavy chain CDR3 for antibody 564 (IGHV3-53)
ARERGDTAMAVGD

SEQ ID NO: 1129 - protein, 9 aa, Homo sapiens
  Light chain CDR3 for antibody 565 (IGKV1-9)
QQLTSYSYT

SEQ ID NO: 1130 - protein, 13 aa, Homo sapiens
  Heavy chain CDR3 for antibody 565 (IGHV3-53)
ARERGDTAMAVGD

SEQ ID NO: 1131 - protein, 9 aa, Homo sapiens
  Light chain CDR3 for antibody 566 (IGKV1-33)
QQYDNLPLT

SEQ ID NO: 1132 - protein, 18 aa, Homo sapiens
  Heavy chain CDR3 for antibody 566 (IGHV1-69)
ARDRLRIQLSPHYYYMDV

SEQ ID NO: 1133 - protein, 9 aa, Homo sapiens
  Light chain CDR3 for antibody 567 (IGKV3-20)
QQYGSSPQT

SEQ ID NO: 1134 - protein, 17 aa, Homo sapiens
  Heavy chain CDR3 for antibody 567 (IGHV4-39)
ARARRITIFGVVNEVDY

SEQ ID NO: 1135 - protein, 9 aa, Homo sapiens
  Light chain CDR3 for antibody 568 (IGKV1-5)
QQYRGYSWT

SEQ ID NO: 1136 - protein, 12 aa, Homo sapiens
  Heavy chain CDR3 for antibody 568 (IGHV4-30-2)
ATYAVGAGGRGS

SEQ ID NO: 1137 - protein, 11 aa, Homo sapiens
  Light chain CDR3 for antibody 569 (IGKV1-12)
QQYDNLPFALT

SEQ ID NO: 1138 - protein, 11 aa, Homo sapiens
  Heavy chain CDR3 for antibody 569 (IGHV4-30-2)
ARGTKVVTFDS

SEQ ID NO: 1139 - protein, 9 aa, Homo sapiens
  Light chain CDR3 for antibody 570 (IGKV3-20)
QQYGSSPRT

SEQ ID NO: 1140 - protein, 13 aa, Homo sapiens
  Heavy chain CDR3 for antibody 570 (IGHV3-74)
VRDQYGENFYMDV

SEQ ID NO: 1141 - protein, 10 aa, Homo sapiens
  Light chain CDR3 for antibody 571 (IGKV2-30)
MQGTHWPPWT

SEQ ID NO: 1142 - protein, 14 aa, Homo sapiens
  Heavy chain CDR3 for antibody 571 (IGHV1-2)
ARWWIWFGEFIMDV

SEQ ID NO: 1143 - protein, 9 aa, Homo sapiens
  Light chain CDR3 for antibody 572 (IGKV3-20)
HQYGSSPGT

SEQ ID NO: 1144 - protein, 12 aa, Homo sapiens
  Heavy chain CDR3 for antibody 572 (IGHV1-2)
ARSYYSSGNFDY

SEQ ID NO: 1145 - protein, 10 aa, Homo sapiens
  Light chain CDR3 for antibody 573 (IGKV1-39)
QQSYSTPPIT

SEQ ID NO: 1146 - protein, 24 aa, Homo sapiens
  Heavy chain CDR3 for antibody 573 (IGHV1-46)
AGPITMVRGVIIPDYYYYYYGMDV

SEQ ID NO: 1147 - protein, 9 aa, Homo sapiens
  Light chain CDR3 for antibody 574 (IGKV1-12)
QEADGFPWA

SEQ ID NO: 1148 - protein, 19 aa, Homo sapiens
  Heavy chain CDR3 for antibody 574 (IGHV1-69)
ARDRLRIQLSPHYYYYMDV

SEQ ID NO: 1149 - protein, 10 aa, Homo sapiens
  Light chain CDR3 for antibody 575 (IGKV3-20)
QQYGSSPPDT

SEQ ID NO: 1150 - protein, 13 aa, Homo sapiens
  Heavy chain CDR3 for antibody 575 (IGHV3-53)
ARERGDTAMAVGD

SEQ ID NO: 1151 - protein, 10 aa, Homo sapiens
  Light chain CDR3 for antibody 576 (IGKV1-12)
QQGNSFLPTT

SEQ ID NO: 1152 - protein, 13 aa, Homo sapiens
  Heavy chain CDR3 for antibody 576 (IGHV4-b)
AAGVVTRHRTLDY

SEQ ID NO: 1153 - protein, 9 aa, Homo sapiens
  Light chain CDR3 for antibody 577 (IGKV3-11)
QQRSDWPPT

SEQ ID NO: 1154 - protein, 18 aa, Homo sapiens
  Heavy chain CDR3 for antibody 577 (IGHV4-4)
ARGEAADEVGHHYGALDY

SEQ ID NO: 1155 - protein, 10 aa, Homo sapiens
  Light chain CDR3 for antibody 578 (IGKV1-37)
QRTYNAPRFT

SEQ ID NO: 1156 - protein, 18 aa, Homo sapiens
  Heavy chain CDR3 for antibody 578 (IGHV4-59)
ARGEAADEVGHHYGALDC

SEQ ID NO: 1157 - protein, 9 aa, Homo sapiens
  Light chain CDR3 for antibody 579 (IGKV1-5)
QQYNSNVRT

SEQ ID NO: 1158 - protein, 13 aa, Homo sapiens
  Heavy chain CDR3 for antibody 579 (IGHV3-23)
AKDKRGYTKPVDS

SEQ ID NO: 1159 - protein, 9 aa, Homo sapiens
  Light chain CDR3 for antibody 580 (IGKV3-20)
HQYGSTYWT

SEQ ID NO: 1160 - protein, 10 aa, Homo sapiens
  Heavy chain CDR3 for antibody 580 (IGHV3-23)
RNYDWVSRDC

SEQ ID NO: 1161 - protein, 9 aa, Homo sapiens
  Light chain CDR3 for antibody 581 (IGKV1-5)
QQYNSYPYT

SEQ ID NO: 1162 - protein, 15 aa, Homo sapiens
  Heavy chain CDR3 for antibody 581 (IGHV1-46)
AGGDGGNFRADAFDI

SEQ ID NO: 1163 - protein, 10 aa, Homo sapiens
  Light chain CDR3 for antibody 582 (IGKV3-20)
QQYGSSPLFT

SEQ ID NO: 1164 - protein, 22 aa, Homo sapiens
  Heavy chain CDR3 for antibody 582 (IGHV1-18)
ARVLVRYGAGSYPVYNYYGMDV

SEQ ID NO: 1165 - protein, 9 aa, Homo sapiens
  Light chain CDR3 for antibody 583 (IGKV1-16)
QQYSSYPPT

SEQ ID NO: 1166 - protein, 11 aa, Homo sapiens
  Heavy chain CDR3 for antibody 583 (IGHV5-51)
ARPQDREGVGY

SEQ ID NO: 1167 - protein, 10 aa, Homo sapiens
  Light chain CDR3 for antibody 584 (IGKV1-39)
QQSYSTPPIT

SEQ ID NO: 1168 - protein, 13 aa, Homo sapiens
  Heavy chain CDR3 for antibody 584 (IGHV5-51)
ARRYSGFHAELDY

SEQ ID NO: 1169 - protein, 10 aa, Homo sapiens
  Light chain CDR3 for antibody 585 (IGKV1-39)
QQSYSTPPIT

SEQ ID NO: 1170 - protein, 9 aa, Homo sapiens
  Heavy chain CDR3 for antibody 585 (IGHV4-61)
VRGRGRTTT

SEQ ID NO: 1171 - protein, 9 aa, Homo sapiens
  Light chain CDR3 for antibody 586 (IGKV1-33)
QQYDNLPLT

SEQ ID NO: 1172 - protein, 16 aa, Homo sapiens
  Heavy chain CDR3 for antibody 586 (IGHV1-18)
ARANPGAVGYYYGMDV

SEQ ID NO: 1173 - protein, 10 aa, Homo sapiens
  Light chain CDR3 for antibody 587 (IGKV1-39)
QQSYSTPPIT

SEQ ID NO: 1174 - protein, 16 aa, Homo sapiens
  Heavy chain CDR3 for antibody 587 (IGHV1-18)
ARANPGAVGYYYGMDV

SEQ ID NO: 1175 - protein, 9 aa, Homo sapiens
  Light chain CDR3 for antibody 588 (IGKV1-33)
QQYDNLPLT

SEQ ID NO: 1176 - protein, 11 aa, Homo sapiens
  Heavy chain CDR3 for antibody 588 (IGHV3-53)
ARDLQVYGMDV

SEQ ID NO: 1177 - protein, 10 aa, Homo sapiens
  Light chain CDR3 for antibody 589 (IGKV1-39)
QQSYSTPPIT

SEQ ID NO: 1178 - protein, 13 aa, Homo sapiens
  Heavy chain CDR3 for antibody 589 (IGHV3-74)
VRDQYGENFYMDV

SEQ ID NO: 1179 - protein, 9 aa, Homo sapiens
  Light chain CDR3 for antibody 590 (IGKV1-33)
QQYDNLPLT

SEQ ID NO: 1180 - protein, 14 aa, Homo sapiens
  Heavy chain CDR3 for antibody 590 (IGHV3-30)
AKEATKRASRHFDF

SEQ ID NO: 1181 - protein, 9 aa, Homo sapiens
  Light chain CDR3 for antibody 591 (IGKV1-39)
QQSYSTPPT

SEQ ID NO: 1182 - protein, 19 aa, Homo sapiens
  Heavy chain CDR3 for antibody 591 (IGHV1-69)
ARDRLRIQLSPHYYYYMDV

SEQ ID NO: 1183 - protein, 9 aa, Homo sapiens
  Light chain CDR3 for antibody 592 (IGKV3-20)
HQYGSTPWT

SEQ ID NO: 1184 - protein, 13 aa, Homo sapiens
  Heavy chain CDR3 for antibody 592 (IGHV3-53)
ARERGDTAMAVGD

SEQ ID NO: 1185 - protein, 9 aa, Homo sapiens
  Light chain CDR3 for antibody 593 (IGKV1-6)
LQDFTYPRT

SEQ ID NO: 1186 - protein, 19 aa, Homo sapiens
  Heavy chain CDR3 for antibody 593 (IGHV3-33)
ARDSSPGGQQTGWFDVFDI

SEQ ID NO: 1187 - protein, 9 aa, Homo sapiens
  Light chain CDR3 for antibody 594 (IGKV1-12)
QHANGFPWT

SEQ ID NO: 1188 - protein, 14 aa, Homo sapiens
  Heavy chain CDR3 for antibody 594 (IGHV3-30)
AKEASKRASRNFDF

SEQ ID NO: 1189 - protein, 9 aa, Homo sapiens
  Light chain CDR3 for antibody 595 (IGKV1-39)
QQSYSFPHT

SEQ ID NO: 1190 - protein, 11 aa, Homo sapiens
  Heavy chain CDR3 for antibody 595 (IGHV4-59)
ARWKFGRQFDF

SEQ ID NO: 1191 - protein, 9 aa, Homo sapiens
  Light chain CDR3 for antibody 596 (IGKV1-33)
RQYDAFPIT

SEQ ID NO: 1192 - protein, 15 aa, Homo sapiens
  Heavy chain CDR3 for antibody 596 (IGHV1-2)
ARGEIQTLRSMPSDY

SEQ ID NO: 1193 - protein, 9 aa, Homo sapiens
  Light chain CDR3 for antibody 597 (IGKV3-11)
QQRNIWPLT

SEQ ID NO: 1194 - protein, 13 aa, Homo sapiens
  Heavy chain CDR3 for antibody 597 (IGHV4-4)
ARVQWALYWYFDL

SEQ ID NO: 1195 - protein, 9 aa, Homo sapiens
  Light chain CDR3 for antibody 598 (IGKV1-12)
QQANSLPLT

SEQ ID NO: 1196 - protein, 15 aa, Homo sapiens
  Heavy chain CDR3 for antibody 598 (IGHV3-23)
AKGLHHGSGTYFPAS

SEQ ID NO: 1197 - protein, 9 aa, Homo sapiens
  Light chain CDR3 for antibody 599 (IGKV1-39)
QQSYSTPLT

SEQ ID NO: 1198 - protein, 14 aa, Homo sapiens
  Heavy chain CDR3 for antibody 599 (IGHV3-21)
AREPARPRGYYFDY

SEQ ID NO: 1199 - protein, 9 aa, Homo sapiens
  Light chain CDR3 for antibody 600 (IGKV1D-12)
QQGDSFPLT

SEQ ID NO: 1200 - protein, 13 aa, Homo sapiens
  Heavy chain CDR3 for antibody 600 (IGHV3-53)
ARERGDTAMAVGD

SEQ ID NO: 1201 - protein, 9 aa, Homo sapiens
  Light chain CDR3 for antibody 601 (IGKV3-20)
QQYGSSLYT

SEQ ID NO: 1202 - protein, 24 aa, Homo sapiens
  Heavy chain CDR3 for antibody 601 (IGHV1-46)
AGPITMVRGVIIPDYYYYYYGMDV

SEQ ID NO: 1203 - protein, 8 aa, Homo sapiens
  Light chain CDR3 for antibody 602 (IGKV3-20)
QQYGSSPT

SEQ ID NO: 1204 - protein, 16 aa, Homo sapiens
  Heavy chain CDR3 for antibody 602 (IGHV1-18)
ARANPGAVGYYYGMDV

SEQ ID NO: 1205 - protein, 9 aa, Homo sapiens
  Light chain CDR3 for antibody 603 (IGKV1-27)
QKYNTAPWT

SEQ ID NO: 1206 - protein, 16 aa, Homo sapiens
  Heavy chain CDR3 for antibody 603 (IGHV3-9)
AKAKRGTAMVSDGFNL

SEQ ID NO: 1207 - protein, 10 aa, Homo sapiens
  Light chain CDR3 for antibody 604 (IGKV1-39)
QQSYSTPPIT

SEQ ID NO: 1208 - protein, 20 aa, Homo sapiens
  Heavy chain CDR3 for antibody 604 (IGHV4-39)
ARTGHLIRFLEWLPINWFDP

SEQ ID NO: 1209 - protein, 9 aa, Homo sapiens
  Light chain CDR3 for antibody 605 (IGKV1-33)
QQYANFPLT

SEQ ID NO: 1210 - protein, 9 aa, Homo sapiens
  Heavy chain CDR3 for antibody 605 (IGHV4-59)
ARATNSFDP

SEQ ID NO: 1211 - protein, 11 aa, Homo sapiens
  Light chain CDR3 for antibody 606 (IGKV3-11)
QQRSNWPPRLT

SEQ ID NO: 1212 - protein, 15 aa, Homo sapiens
  Heavy chain CDR3 for antibody 606 (IGHV3-30)
AKGCPGGTNCFYFDF

SEQ ID NO: 1213 - protein, 10 aa, Homo sapiens
  Light chain CDR3 for antibody 607 (IGKV1-39)
QQSYSTPPWT

SEQ ID NO: 1214 - protein, 15 aa, Homo sapiens
  Heavy chain CDR3 for antibody 607 (IGHV1-46)
AGGDGGNFRADAFDI

SEQ ID NO: 1215 - protein, 10 aa, Homo sapiens
  Light chain CDR3 for antibody 608 (IGKV1-39)
QQSYSTPPWT

SEQ ID NO: 1216 - protein, 17 aa, Homo sapiens
  Heavy chain CDR3 for antibody 608 (IGHV3-13)
ARGVSSSWGYYYYYMDV

SEQ ID NO: 1217 - protein, 9 aa, Homo sapiens
  Light chain CDR3 for antibody 609 (IGKV1-12)
QEADGFPWA

SEQ ID NO: 1218 - protein, 12 aa, Homo sapiens
  Heavy chain CDR3 for antibody 609 (IGHV3-15)
TTSVGGNSGVDC

SEQ ID NO: 1219 - protein, 9 aa, Homo sapiens
  Light chain CDR3 for antibody 610 (IGKV2-30)
MQGSHWPPT

SEQ ID NO: 1220 - protein, 12 aa, Homo sapiens
  Heavy chain CDR3 for antibody 610 (IGHV3-23)
ANIPTLTTISDY

SEQ ID NO: 1221 - protein, 9 aa, Homo sapiens
  Light chain CDR3 for antibody 611 (IGKV1-33)
QQYDNLPLT

SEQ ID NO: 1222 - protein, 13 aa, Homo sapiens
  Heavy chain CDR3 for antibody 611 (IGHV1-69)
ARFPNAALRAFDI

SEQ ID NO: 1223 - protein, 9 aa, Homo sapiens
  Light chain CDR3 for antibody 612 (IGKV1-33)
QQYDNLPLT

SEQ ID NO: 1224 - protein, 9 aa, Homo sapiens
  Heavy chain CDR3 for antibody 612 (IGHV3-53)
ARESYGMDV

SEQ ID NO: 1225 - protein, 9 aa, Homo sapiens
  Light chain CDR3 for antibody 613 (IGKV3-11)
QQRSNWPRT

SEQ ID NO: 1226 - protein, 19 aa, Homo sapiens
  Heavy chain CDR3 for antibody 613 (IGHV4-31)
ASQGGDDYVWGSWGYGMDV

SEQ ID NO: 1227 - protein, 10 aa, Homo sapiens
  Light chain CDR3 for antibody 614 (IGKV1-5)
QQYHSYSPKT

SEQ ID NO: 1228 - protein, 18 aa, Homo sapiens
  Heavy chain CDR3 for antibody 614 (IGHV5-a)
ARPMRSSSSHFLSYGMDV

SEQ ID NO: 1229 - protein, 10 aa, Homo sapiens
  Light chain CDR3 for antibody 615 (IGKV1-39)
QQSYSTPPIT

SEQ ID NO: 1230 - protein, 12 aa, Homo sapiens
  Heavy chain CDR3 for antibody 615 (IGHV3-53)
ARDLGSVGATDY

SEQ ID NO: 1231 - protein, 10 aa, Homo sapiens
  Light chain CDR3 for antibody 616 (IGKV1-39)
QQSYSTPPIT

SEQ ID NO: 1232 - protein, 11 aa, Homo sapiens
  Heavy chain CDR3 for antibody 616 (IGHV4-30-2)
ARGTKVVTFDS

SEQ ID NO: 1233 - protein, 11 aa, Homo sapiens
  Light chain CDR3 for antibody 617 (IGKV3-15)
QQYNNWPPMYT

SEQ ID NO: 1234 - protein, 13 aa, Homo sapiens
  Heavy chain CDR3 for antibody 617 (IGHV3-53)
ARERGDTAMAVGD

SEQ ID NO: 1235 - protein, 9 aa, Homo sapiens
  Light chain CDR3 for antibody 618 (IGKV1-27)
QKYNSAPLT

SEQ ID NO: 1236 - protein, 13 aa, Homo sapiens
  Heavy chain CDR3 for antibody 618 (IGHV3-53)
ARERGDTAMAVGD

SEQ ID NO: 1237 - protein, 9 aa, Homo sapiens
  Light chain CDR3 for antibody 619 (IGKV1-12)
QQGNSFPPA

SEQ ID NO: 1238 - protein, 19 aa, Homo sapiens
  Heavy chain CDR3 for antibody 619 (IGHV1-69)
ARDRLRIQLSPHYYYYMDV

SEQ ID NO: 1239 - protein, 10 aa, Homo sapiens
  Light chain CDR3 for antibody 620 (IGKV3-20)
QQYGSSPPDT

SEQ ID NO: 1240 - protein, 19 aa, Homo sapiens
  Heavy chain CDR3 for antibody 620 (IGHV1-69)
ARDRLRIQLSPHYYYYMDV

SEQ ID NO: 1241 - protein, 9 aa, Homo sapiens
  Light chain CDR3 for antibody 621 (IGKV1-33)
QQYDNLPLT

SEQ ID NO: 1242 - protein, 12 aa, Homo sapiens
  Heavy chain CDR3 for antibody 621 (IGHV3-64)
ASLAGYSGYYDY

SEQ ID NO: 1243 - protein, 10 aa, Homo sapiens
  Light chain CDR3 for antibody 622 (IGKV1-39)
QQSYSTPPIT

SEQ ID NO: 1244 - protein, 13 aa, Homo sapiens
  Heavy chain CDR3 for antibody 622 (IGHV3-53)
ARERGDKDMEVGE

SEQ ID NO: 1245 - protein, 9 aa, Homo sapiens
  Light chain CDR3 for antibody 623 (IGKV3-20)
QQYGSSTET

SEQ ID NO: 1246 - protein, 26 aa, Homo sapiens
  Heavy chain CDR3 for antibody 623 (IGHV4-34)
ARGRITVVPAPILGVGPYYDCYYLDV

SEQ ID NO: 1247 - protein, 10 aa, Homo sapiens
  Light chain CDR3 for antibody 624 (IGKV1-39)
QQSYSTPPIT

SEQ ID NO: 1248 - protein, 19 aa, Homo sapiens
  Heavy chain CDR3 for antibody 624 (IGHV1-69)
ARAHRSSTSYRLGINWFDP

SEQ ID NO: 1249 - protein, 9 aa, Homo sapiens
  Light chain CDR3 for antibody 625 (IGKV1-9)
QQLNSYSYT

SEQ ID NO: 1250 - protein, 14 aa, Homo sapiens
  Heavy chain CDR3 for antibody 625 (IGHV3-30)
AKEATKRASRHFDF

SEQ ID NO: 1251 - protein, 9 aa, Homo sapiens
  Light chain CDR3 for antibody 626 (IGKV3-11)
QQRSDWPPT

SEQ ID NO: 1252 - protein, 13 aa, Homo sapiens
  Heavy chain CDR3 for antibody 626 (IGHV3-53)
ARERGDTAMAVGD

SEQ ID NO: 1253 - protein, 10 aa, Homo sapiens
  Light chain CDR3 for antibody 627 (IGKV1-39)
QQSYSTPPIT

SEQ ID NO: 1254 - protein, 13 aa, Homo sapiens
  Heavy chain CDR3 for antibody 627 (IGHVVISTA32)
SKGPGDTAMAVGD

SEQ ID NO: 1255 - protein, 10 aa, Homo sapiens
  Light chain CDR3 for antibody 628 (IGKV1-39)
QQSYSTPPIT

SEQ ID NO: 1256 - protein, 13 aa, Homo sapiens
  Heavy chain CDR3 for antibody 628 (IGHV3-53)
ARERGDTAIAVGH

SEQ ID NO: 1257 - protein, 8 aa, Homo sapiens
  Light chain CDR3 for antibody 629 (IGKV2D-28)
MQALQTIT

SEQ ID NO: 1258 - protein, 13 aa, Homo sapiens
  Heavy chain CDR3 for antibody 629 (IGHV3-53)
ARERGDTAMAVGD

SEQ ID NO: 1259 - protein, 9 aa, Homo sapiens
  Light chain CDR3 for antibody 630 (IGKV1-33)
QQYDNLPIT

SEQ ID NO: 1260 - protein, 11 aa, Homo sapiens
  Heavy chain CDR3 for antibody 630 (IGHV3-53)
ARDLGPYGMDV

SEQ ID NO: 1261 - protein, 8 aa, Homo sapiens
  Light chain CDR3 for antibody 631 (IGKV3-20)
QQYGSSPT

SEQ ID NO: 1262 - protein, 14 aa, Homo sapiens
  Heavy chain CDR3 for antibody 631 (IGHV3-30)
AKEATKRASRHFDF

SEQ ID NO: 1263 - protein, 8 aa, Homo sapiens
  Light chain CDR3 for antibody 632 (IGKV3-20)
QQYGSSPT

SEQ ID NO: 1264 - protein, 13 aa, Homo sapiens
  Heavy chain CDR3 for antibody 632 (IGHV1-69)
ARFPNAALRAFDI

SEQ ID NO: 1265 - protein, 9 aa, Homo sapiens
  Light chain CDR3 for antibody 633 (IGKV1-39)
QQSYSTPKT

SEQ ID NO: 1266 - protein, 9 aa, Homo sapiens
  Heavy chain CDR3 for antibody 633 (IGHV3-53)
ARESYGMDV

SEQ ID NO: 1267 - protein, 8 aa, Homo sapiens
  Light chain CDR3 for antibody 634 (IGKV3-20)
QQYGSSPT

SEQ ID NO: 1268 - protein, 11 aa, Homo sapiens
  Heavy chain CDR3 for antibody 634 (IGHV3-53)
ARDLGPYGMDV

SEQ ID NO: 1269 - protein, 9 aa, Homo sapiens
  Light chain CDR3 for antibody 635 (IGKV1-39)
QQSYSAPWT

SEQ ID NO: 1270 - protein, 18 aa, Homo sapiens
  Heavy chain CDR3 for antibody 635 (IGHV2-26)
ARSMSELRLWYFYYFMDV

SEQ ID NO: 1271 - protein, 10 aa, Homo sapiens
  Light chain CDR3 for antibody 636 (IGKV1-39)
QQSYSTPPIT

SEQ ID NO: 1272 - protein, 13 aa, Homo sapiens
  Heavy chain CDR3 for antibody 636 (IGHV3-53)
ARERRDASMAVGD

SEQ ID NO: 1273 - protein, 9 aa, Homo sapiens
  Light chain CDR3 for antibody 637 (IGKV1-33)
QQYDNLPLT

SEQ ID NO: 1274 - protein, 19 aa, Homo sapiens
  Heavy chain CDR3 for antibody 637 (IGHV1-69)
ARDRLRIQRAPRYYYYMDV

SEQ ID NO: 1275 - protein, 9 aa, Homo sapiens
  Light chain CDR3 for antibody 638 (IGKV1-5)
QQYNSYSWT

SEQ ID NO: 1276 - protein, 13 aa, Homo sapiens
  Heavy chain CDR3 for antibody 638 (IGHV3-53)
ARERGDTAMAVGD

SEQ ID NO: 1277 - protein, 9 aa, Homo sapiens
  Light chain CDR3 for antibody 639 (IGKV1-27)
QKYNSAPKT

SEQ ID NO: 1278 - protein, 12 aa, Homo sapiens
  Heavy chain CDR3 for antibody 639 (IGHV3-23)
ANIPTLTTISDY

SEQ ID NO: 1279 - protein, 10 aa, Homo sapiens
  Light chain CDR3 for antibody 640 (IGKV1-39)
QQSYSTPPIT

SEQ ID NO: 1280 - protein, 14 aa, Homo sapiens
  Heavy chain CDR3 for antibody 640 (IGHV3-30)
ARSRGGNYYYGMDV

SEQ ID NO: 1281 - protein, 8 aa, Homo sapiens
  Light chain CDR3 for antibody 641 (IGKV1-5)
QQYVSGWT

SEQ ID NO: 1282 - protein, 14 aa, Homo sapiens
  Heavy chain CDR3 for antibody 641 (IGHV4-59)
ARGSTHCGGDCYHD

SEQ ID NO: 1283 - protein, 9 aa, Homo sapiens
  Light chain CDR3 for antibody 642 (IGKV1-39)
QQSYSTPKT

SEQ ID NO: 1284 - protein, 14 aa, Homo sapiens
  Heavy chain CDR3 for antibody 642 (IGHV3-30)
AKEATKRASRHFDF

SEQ ID NO: 1285 - protein, 10 aa, Homo sapiens
  Light chain CDR3 for antibody 643 (IGKV2-30)
MQGTHWPPWT

SEQ ID NO: 1286 - protein, 13 aa, Homo sapiens
  Heavy chain CDR3 for antibody 643 (IGHV3-53)
ARERGDTAMAVGD

SEQ ID NO: 1287 - protein, 9 aa, Homo sapiens
  Light chain CDR3 for antibody 644 (IGKV1-33)
QQYDNLPLT

SEQ ID NO: 1288 - protein, 19 aa, Homo sapiens
  Heavy chain CDR3 for antibody 644 (IGHV1-69)
ARAHRSSTSYRLGINWFDP

SEQ ID NO: 1289 - protein, 9 aa, Homo sapiens
  Light chain CDR3 for antibody 645 (IGKV1-39)
QLSYSTPVA

SEQ ID NO: 1290 - protein, 14 aa, Homo sapiens
  Heavy chain CDR3 for antibody 645 (IGHV3-30)
AKEATKRASRHFDF

SEQ ID NO: 1291 - protein, 9 aa, Homo sapiens
  Light chain CDR3 for antibody 646 (IGKV1-12)
QEADGFPWA

SEQ ID NO: 1292 - protein, 11 aa, Homo sapiens
  Heavy chain CDR3 for antibody 646 (IGHV3-53)
ARDLQPYGMDV

SEQ ID NO: 1293 - protein, 10 aa, Homo sapiens
  Light chain CDR3 for antibody 647 (IGKV1-39)
QQSYSTPPIT

SEQ ID NO: 1294 - protein, 13 aa, Homo sapiens
  Heavy chain CDR3 for antibody 647 (IGHV3-53)
ARERGDTAMALGH

SEQ ID NO: 1295 - protein, 10 aa, Homo sapiens
  Light chain CDR3 for antibody 648 (IGKV1-39)
QQSYSTPPIT

SEQ ID NO: 1296 - protein, 13 aa, Homo sapiens
  Heavy chain CDR3 for antibody 648 (IGHV3-53)
ARERGHTAMPVGH

SEQ ID NO: 1297 - protein, 9 aa, Homo sapiens
  Light chain CDR3 for antibody 649 (IGKV1-33)
QQYDNLPIT

SEQ ID NO: 1298 - protein, 12 aa, Homo sapiens
  Heavy chain CDR3 for antibody 649 (IGHV3-53)
ARDLGSVGATDY

SEQ ID NO: 1299 - protein, 10 aa, Homo sapiens
  Light chain CDR3 for antibody 650 (IGKV1-39)
QQSYSTPPIT

SEQ ID NO: 1300 - protein, 11 aa, Homo sapiens
  Heavy chain CDR3 for antibody 650 (IGHV3-53)
ARDKWEGAFDI

SEQ ID NO: 1301 - protein, 10 aa, Homo sapiens
  Light chain CDR3 for antibody 651 (IGKV1-39)
QQSYSTPPIT

SEQ ID NO: 1302 - protein, 13 aa, Homo sapiens
  Heavy chain CDR3 for antibody 651 (IGHV3-53)
ARERGDTAKSVRY

SEQ ID NO: 1303 - protein, 10 aa, Homo sapiens
  Light chain CDR3 for antibody 652 (IGKV1-39)
HQSCSTPPIT

SEQ ID NO: 1304 - protein, 13 aa, Homo sapiens
  Heavy chain CDR3 for antibody 652 (IGHV3-53)
ARERGDTAMAVGD

SEQ ID NO: 1305 - protein, 8 aa, Homo sapiens
  Light chain CDR3 for antibody 653 (IGKV3-20)
QQYGSSPT

SEQ ID NO: 1306 - protein, 23 aa, Homo sapiens
  Heavy chain CDR3 for antibody 653 (IGHV1-8)
AGPITMVRGVIIPDYYYYYGMDV

SEQ ID NO: 1307 - protein, 10 aa, Homo sapiens
  Light chain CDR3 for antibody 654 (IGKV1-39)
QQSYSTPPIT

SEQ ID NO: 1308 - protein, 10 aa, Homo sapiens
  Heavy chain CDR3 for antibody 654 (IGHV4-39)
ARETESRGDY

SEQ ID NO: 1309 - protein, 9 aa, Homo sapiens
  Light chain CDR3 for antibody 655 (IGKV1-9)
QQLNSYPQT

SEQ ID NO: 1310 - protein, 12 aa, Homo sapiens
  Heavy chain CDR3 for antibody 655 (IGHV3-64)
ASLAGYSGYYDY

SEQ ID NO: 1311 - protein, 10 aa, Homo sapiens
  Light chain CDR3 for antibody 656 (IGKV1-39)
QQSYSTPRLP

SEQ ID NO: 1312 - protein, 13 aa, Homo sapiens
  Heavy chain CDR3 for antibody 656 (IGHV3-53)
ARERGDTAMAVGD

SEQ ID NO: 1313 - protein, 10 aa, Homo sapiens
  Light chain CDR3 for antibody 657 (IGKV1-39)
QQSYSTPPIT

SEQ ID NO: 1314 - protein, 13 aa, Homo sapiens
  Heavy chain CDR3 for antibody 657 (IGHV3-53)
ARELGDAAMAVED

SEQ ID NO: 1315 - protein, 10 aa, Homo sapiens
  Light chain CDR3 for antibody 658 (IGKV1-39)
QQSYSTPPIT

SEQ ID NO: 1316 - protein, 13 aa, Homo sapiens
  Heavy chain CDR3 for antibody 658 (IGHV3-66)
AREQGDTTIAVGD

SEQ ID NO: 1317 - protein, 9 aa, Homo sapiens
  Light chain CDR3 for antibody 659 (IGKV1-33)
QQYDNLPLT

SEQ ID NO: 1318 - protein, 13 aa, Homo sapiens
  Heavy chain CDR3 for antibody 659 (IGHV3-74)
VRDQYGENFYMDV

SEQ ID NO: 1319 - protein, 10 aa, Homo sapiens
  Light chain CDR3 for antibody 660 (IGKV3-20)
QQYGSSPPAP

SEQ ID NO: 1320 - protein, 20 aa, Homo sapiens
  Heavy chain CDR3 for antibody 660 (IGHV4-39)
ARTGHLIRFLEWLPINWFDP

SEQ ID NO: 1321 - protein, 10 aa, Homo sapiens
  Light chain CDR3 for antibody 661 (IGKV1-39)
QQSYSIPPIT

SEQ ID NO: 1322 - protein, 13 aa, Homo sapiens
  Heavy chain CDR3 for antibody 661 (IGHV3-53)
ARERGDTSMAFDD

SEQ ID NO: 1323 - protein, 10 aa, Homo sapiens
  Light chain CDR3 for antibody 662 (IGKV1-39)
QQSYSTPPIT

SEQ ID NO: 1324 - protein, 13 aa, Homo sapiens
  Heavy chain CDR3 for antibody 662 (IGHV3-53)
ARESGYTAKAVVD

SEQ ID NO: 1325 - protein, 9 aa, Homo sapiens
  Light chain CDR3 for antibody 663 (IGKV1-33)
QQYDNLPLT

SEQ ID NO: 1326 - protein, 13 aa, Homo sapiens
  Heavy chain CDR3 for antibody 663 (IGHV1-69)
ASCTNYYYYYMYV

SEQ ID NO: 1327 - protein, 10 aa, Homo sapiens
  Light chain CDR3 for antibody 664 (IGKV1-39)
QKINSTPPIT

SEQ ID NO: 1328 - protein, 13 aa, Homo sapiens
  Heavy chain CDR3 for antibody 664 (IGHV3-53)
ARERGDTAMAVGD

SEQ ID NO: 1329 - protein, 10 aa, Homo sapiens
  Light chain CDR3 for antibody 665 (IGKV1-39)
QQSYSTPPIT

SEQ ID NO: 1330 - protein, 13 aa, Homo sapiens
  Heavy chain CDR3 for antibody 665 (IGHV3-53)
AREQGYTAMAFGD

SEQ ID NO: 1331 - protein, 10 aa, Homo sapiens
  Light chain CDR3 for antibody 666 (IGKV1-39)
QQSYSTPPIT

SEQ ID NO: 1332 - protein, 13 aa, Homo sapiens
  Heavy chain CDR3 for antibody 666 (IGHV3-53)
ARERGDKAKAVGY

SEQ ID NO: 1333 - protein, 9 aa, Homo sapiens
  Light chain CDR3 for antibody 667 (IGKV3-20)
QQYGSSPQT

SEQ ID NO: 1334 - protein, 14 aa, Homo sapiens
  Heavy chain CDR3 for antibody 667 (IGHV3-30)
AKEATKRASRHFDF

SEQ ID NO: 1335 - protein, 9 aa, Homo sapiens
  Light chain CDR3 for antibody 668 (IGKV3-20)
QQYGSSPYT

SEQ ID NO: 1336 - protein, 19 aa, Homo sapiens
  Heavy chain CDR3 for antibody 668 (IGHV1-69)
ARAHRSSTSYRLGINWFDP

SEQ ID NO: 1337 - protein, 9 aa, Homo sapiens
  Light chain CDR3 for antibody 669 (IGKV1-33)
QQYDNLPLT

SEQ ID NO: 1338 - protein, 20 aa, Homo sapiens
  Heavy chain CDR3 for antibody 669 (IGHV4-39)
ARTGHLIRFLEWLPINWFDP

SEQ ID NO: 1339 - protein, 9 aa, Homo sapiens
  Light chain CDR3 for antibody 670 (IGKV3-20)
QQYGSSLYT

SEQ ID NO: 1340 - protein, 19 aa, Homo sapiens
  Heavy chain CDR3 for antibody 670 (IGHV1-2)
ARDRLRIQISPHYYYYMDV

SEQ ID NO: 1341 - protein, 10 aa, Homo sapiens
  Light chain CDR3 for antibody 671 (IGKV1-39)
QQSYSTPPIT

SEQ ID NO: 1342 - protein, 13 aa, Homo sapiens
  Heavy chain CDR3 for antibody 671 (IGHV3-53)
ARERGDTAKTIGD

SEQ ID NO: 1343 - protein, 9 aa, Homo sapiens
  Light chain CDR3 for antibody 672 (IGKV1-12)
QEADGFPWA

SEQ ID NO: 1344 - protein, 13 aa, Homo sapiens
  Heavy chain CDR3 for antibody 672 (IGHV4-31)
ARDYGGNSAQFGY

SEQ ID NO: 1345 - protein, 9 aa, Homo sapiens
  Light chain CDR3 for antibody 673 (IGKV1-33)
QQYDNLPLT

SEQ ID NO: 1346 - protein, 21 aa, Homo sapiens
  Heavy chain CDR3 for antibody 673 (IGHV1-69)
ARDRLRIQLSPHYYYYMAVGD

SEQ ID NO: 1347 - protein, 10 aa, Homo sapiens
  Light chain CDR3 for antibody 674 (IGKV1-39)
QQSYSTPPIT

SEQ ID NO: 1348 - protein, 13 aa, Homo sapiens
  Heavy chain CDR3 for antibody 674 (IGHV3-53)
ARERGDTDKAVED

SEQ ID NO: 1349 - protein, 10 aa, Homo sapiens
  Light chain CDR3 for antibody 675 (IGKV1-12)
QQVNSYPGPT

SEQ ID NO: 1350 - protein, 12 aa, Homo sapiens
  Heavy chain CDR3 for antibody 675 (IGHV3-66)
ARDLSAAGGFDY

SEQ ID NO: 1351 - protein, 9 aa, Homo sapiens
  Light chain CDR3 for antibody 676 (IGKV1-33)
QQYDNLPIT

SEQ ID NO: 1352 - protein, 14 aa, Homo sapiens
  Heavy chain CDR3 for antibody 676 (IGHV2-5)
AHRLSAMVSSYFDY

SEQ ID NO: 1353 - protein, 10 aa, Homo sapiens
  Light chain CDR3 for antibody 677 (IGKV1-39)
QQSYSTPPIT

SEQ ID NO: 1354 - protein, 13 aa, Homo sapiens
  Heavy chain CDR3 for antibody 677 (IGHV3-53)
ARERGHTAIALGD

SEQ ID NO: 1355 - protein, 10 aa, Homo sapiens
  Light chain CDR3 for antibody 678 (IGKV1-39)
QQSYSTPPIT

SEQ ID NO: 1356 - protein, 10 aa, Homo sapiens
  Heavy chain CDR3 for antibody 678 (IGHV6-1)
ARDWEYSLDY

SEQ ID NO: 1357 - protein, 9 aa, Homo sapiens
  Light chain CDR3 for antibody 679 (IGKV1-33)
QQYDNLPYS

SEQ ID NO: 1358 - protein, 16 aa, Homo sapiens
  Heavy chain CDR3 for antibody 679 (IGHV4-39)
VRPTMNTEGGVHWFDP

SEQ ID NO: 1359 - protein, 9 aa, Homo sapiens
  Light chain CDR3 for antibody 680 (IGKV1-9)
QQLNSYPYT

SEQ ID NO: 1360 - protein, 13 aa, Homo sapiens
  Heavy chain CDR3 for antibody 680 (IGHV5-51)
ARRYSGFHAELDY

SEQ ID NO: 1361 - protein, 9 aa, Homo sapiens
  Light chain CDR3 for antibody 681 (IGKV1-33)
QQYDNLPLT

SEQ ID NO: 1362 - protein, 19 aa, Homo sapiens
  Heavy chain CDR3 for antibody 681 (IGHV1-69)
ARDRVRIQVSPHYYYYMDV

SEQ ID NO: 1363 - protein, 9 aa, Homo sapiens
  Light chain CDR3 for antibody 682 (IGKV1-9)
QQLNSYPPP

SEQ ID NO: 1364 - protein, 9 aa, Homo sapiens
  Heavy chain CDR3 for antibody 682 (IGHV3-53)
ARESYGMDV

SEQ ID NO: 1365 - protein, 9 aa, Homo sapiens
  Light chain CDR3 for antibody 683 (IGKV3-20)
HQYAYAPLT

SEQ ID NO: 1366 - protein, 13 aa, Homo sapiens
  Heavy chain CDR3 for antibody 683 (IGHV3-53)
ARERGDTAMAVGD

SEQ ID NO: 1367 - protein, 9 aa, Homo sapiens
  Light chain CDR3 for antibody 684 (IGKV1-33)
QQYDNLPLT

SEQ ID NO: 1368 - protein, 11 aa, Homo sapiens
  Heavy chain CDR3 for antibody 684 (IGHV4-30-2)
ARGTKVVTFDS

SEQ ID NO: 1369 - protein, 9 aa, Homo sapiens
  Light chain CDR3 for antibody 685 (IGKV1-33)
QQYDNLPIT

SEQ ID NO: 1370 - protein, 18 aa, Homo sapiens
  Heavy chain CDR3 for antibody 685 (IGHV3-13)
ARGVSSSWGYYYYYYMDV

SEQ ID NO: 1371 - protein, 11 aa, Homo sapiens
  Light chain CDR3 for antibody 686 (IGKV3-15)
QQYNNWPPMYT

SEQ ID NO: 1372 - protein, 16 aa, Homo sapiens
  Heavy chain CDR3 for antibody 686 (IGHV1-18)
ARANPGAVGYYYGMDV

SEQ ID NO: 1373 - protein, 9 aa, Homo sapiens
  Light chain CDR3 for antibody 687 (IGKV1-9)
QQLNSYSYT

SEQ ID NO: 1374 - protein, 11 aa, Homo sapiens
  Heavy chain CDR3 for antibody 687 (IGHV3-53)
ARDLGAYGMDV

SEQ ID NO: 1375 - protein, 10 aa, Homo sapiens
  Light chain CDR3 for antibody 688 (IGKV1-39)
QQSYSTPPIT

SEQ ID NO: 1376 - protein, 18 aa, Homo sapiens
  Heavy chain CDR3 for antibody 688 (IGHV3-66)
ARYSSGWYRHPLPNGMDV

SEQ ID NO: 1377 - protein, 9 aa, Homo sapiens
  Light chain CDR3 for antibody 689 (IGKV1-33)
QQYDNLPLT

SEQ ID NO: 1378 - protein, 14 aa, Homo sapiens
  Heavy chain CDR3 for antibody 689 (IGHV1-2)
ARWWIWFGEFIMDV

SEQ ID NO: 1379 - protein, 10 aa, Homo sapiens
  Light chain CDR3 for antibody 690 (IGKV1-39)
QQSYSTPPIT

SEQ ID NO: 1380 - protein, 18 aa, Homo sapiens
  Heavy chain CDR3 for antibody 690 (IGHV4-4)
ARGEAADEVGHHYGALDY

SEQ ID NO: 1381 - protein, 10 aa, Homo sapiens
  Light chain CDR3 for antibody 691 (IGKV1-39)
QQSYSTPPIT

SEQ ID NO: 1382 - protein, 13 aa, Homo sapiens
  Heavy chain CDR3 for antibody 691 (IGHV3-53)
ARERGDAAVAVGA

SEQ ID NO: 1383 - protein, 9 aa, Homo sapiens
  Light chain CDR3 for antibody 692 (IGKV1-12)
QEADGFPWA

SEQ ID NO: 1384 - protein, 16 aa, Homo sapiens
  Heavy chain CDR3 for antibody 692 (IGHV1-18)
ARANPGAVGYYYGMDV

SEQ ID NO: 1385 - protein, 9 aa, Homo sapiens
  Light chain CDR3 for antibody 693 (IGKV1-9)
QQLTSYSYT

SEQ ID NO: 1386 - protein, 19 aa, Homo sapiens
  Heavy chain CDR3 for antibody 693 (IGHV3-53)
ARDRLRIQLSPHYYYYMDV

SEQ ID NO: 1387 - protein, 8 aa, Homo sapiens
  Light chain CDR3 for antibody 694 (IGKV3-15)
QQYNNWPT

SEQ ID NO: 1388 - protein, 15 aa, Homo sapiens
  Heavy chain CDR3 for antibody 694 (IGHV1-69)
ARGGDGYNLVAHYDY

SEQ ID NO: 1389 - protein, 9 aa, Homo sapiens
  Light chain CDR3 for antibody 695 (IGKV3-20)
QQYGSSLYT

SEQ ID NO: 1390 - protein, 19 aa, Homo sapiens
  Heavy chain CDR3 for antibody 695 (IGHV1-69)
ARAHRSSTSYRLGINWFDP

SEQ ID NO: 1391 - protein, 9 aa, Homo sapiens
  Light chain CDR3 for antibody 696 (IGKV1-39)
QQSYSTPGT

SEQ ID NO: 1392 - protein, 15 aa, Homo sapiens
  Heavy chain CDR3 for antibody 696 (IGHV3-64)
VKDVGWVVTVDAFDY

SEQ ID NO: 1393 - protein, 9 aa, Homo sapiens
  Light chain CDR3 for antibody 697 (IGKV1-9)
QQLNSYSYT

SEQ ID NO: 1394 - protein, 12 aa, Homo sapiens
  Heavy chain CDR3 for antibody 697 (IGHV3-53)
ARDLGSVGATDY

SEQ ID NO: 1395 - protein, 9 aa, Homo sapiens
  Light chain CDR3 for antibody 698 (IGKV1-9)
QQLNSYSYT

SEQ ID NO: 1396 - protein, 11 aa, Homo sapiens
  Heavy chain CDR3 for antibody 698 (IGHV3-53)
ARDGRGDLWSY

SEQ ID NO: 1397 - protein, 9 aa, Homo sapiens
  Light chain CDR3 for antibody 699 (IGKV1-39)
QQSYSTPPT

SEQ ID NO: 1398 - protein, 16 aa, Homo sapiens
  Heavy chain CDR3 for antibody 699 (IGHV1-18)
ARANPGAVGYYYGMDV

SEQ ID NO: 1399 - protein, 9 aa, Homo sapiens
  Light chain CDR3 for antibody 700 (IGKV3-20)
QQYGSSPLT

SEQ ID NO: 1400 - protein, 13 aa, Homo sapiens
  Heavy chain CDR3 for antibody 700 (IGHV4-31)
ARDYGGNSAQFGY

SEQ ID NO: 1401 - protein, 9 aa, Homo sapiens
  Light chain CDR3 for antibody 701 (IGKV1-9)
QQLNSYPQT

SEQ ID NO: 1402 - protein, 19 aa, Homo sapiens
  Heavy chain CDR3 for antibody 701 (IGHV1-69)
ARAHRSSTSYRLGINWFDP

SEQ ID NO: 1403 - protein, 9 aa, Homo sapiens
  Light chain CDR3 for antibody 702 (IGKV1-9)
QQLNSYSYT

SEQ ID NO: 1404 - protein, 11 aa, Homo sapiens
  Heavy chain CDR3 for antibody 702 (IGHV3-53)
ARDLGPYGMDV

SEQ ID NO: 1405 - protein, 9 aa, Homo sapiens
  Light chain CDR3 for antibody 703 (IGKV3-20)
QQYGSSLYT

SEQ ID NO: 1406 - protein, 11 aa, Homo sapiens
  Heavy chain CDR3 for antibody 703 (IGHV3-53)
ARDLQVYGMDV

SEQ ID NO: 1407 - protein, 8 aa, Homo sapiens
  Light chain CDR3 for antibody 704 (IGKV1-5)
QQYVTYPT

SEQ ID NO: 1408 - protein, 18 aa, Homo sapiens
  Heavy chain CDR3 for antibody 704 (IGHV4/OR15-8)
ARVDSAWAGTPRFWYFDL

SEQ ID NO: 1409 - protein, 9 aa, Homo sapiens
  Light chain CDR3 for antibody 705 (IGKV3-20)
QQYGSSLYT

SEQ ID NO: 1410 - protein, 9 aa, Homo sapiens
  Heavy chain CDR3 for antibody 705 (IGHV3-53)
ARESYGMDV

SEQ ID NO: 1411 - protein, 9 aa, Homo sapiens
  Light chain CDR3 for antibody 706 (IGKV1-9)
QQLNSYPQT

SEQ ID NO: 1412 - protein, 13 aa, Homo sapiens
  Heavy chain CDR3 for antibody 706 (IGHV4-31)
ARDYGGNSAQFGY

SEQ ID NO: 1413 - protein, 11 aa, Homo sapiens
  Light chain CDR3 for antibody 707 (IGKV3-15)
QQYNNWPPMYT

SEQ ID NO: 1414 - protein, 9 aa, Homo sapiens
  Heavy chain CDR3 for antibody 707 (IGHV3-53)
ARESYGMDV

SEQ ID NO: 1415 - protein, 11 aa, Homo sapiens
  Light chain CDR3 for antibody 708 (IGKV3-15)
QQYNNWPPMYT

SEQ ID NO: 1416 - protein, 11 aa, Homo sapiens
  Heavy chain CDR3 for antibody 708 (IGHV3-53)
ARDLQVYGMDV

SEQ ID NO: 1417 - protein, 9 aa, Homo sapiens
  Light chain CDR3 for antibody 709 (IGKV1-39)
QQSYSTPPT

SEQ ID NO: 1418 - protein, 11 aa, Homo sapiens
  Heavy chain CDR3 for antibody 709 (IGHV3-53)
ARDLQVYGMDV

SEQ ID NO: 1419 - protein, 9 aa, Homo sapiens
  Light chain CDR3 for antibody 710 (IGKV1-9)
QQSLTIPYT

SEQ ID NO: 1420 - protein, 9 aa, Homo sapiens
  Heavy chain CDR3 for antibody 710 (IGHV3-53)
ARESYGMDV

SEQ ID NO: 1421 - protein, 8 aa, Homo sapiens
  Light chain CDR3 for antibody 711 (IGKV1-33)
QQYDNLPS

SEQ ID NO: 1422 - protein, 19 aa, Homo sapiens
  Heavy chain CDR3 for antibody 711 (IGHV1-69)
ARAHRSSTSYRLGINWFDP

SEQ ID NO: 1423 - protein, 12 aa, Homo sapiens
  Light chain CDR3 for antibody 712 (IGKV3-11)
QQRSIWPPKPLT

SEQ ID NO: 1424 - protein, 11 aa, Homo sapiens
  Heavy chain CDR3 for antibody 712 (IGHV4-59)
ARLYGIESRDY

SEQ ID NO: 1425 - protein, 9 aa, Homo sapiens
  Light chain CDR3 for antibody 713 (IGKV1-39)
QQSYSTPPT

SEQ ID NO: 1426 - protein, 18 aa, Homo sapiens
  Heavy chain CDR3 for antibody 713 (IGHV1-69)
ARGAGIVGAIGRHSFFNY

SEQ ID NO: 1427 - protein, 9 aa, Homo sapiens
  Light chain CDR3 for antibody 714 (IGKV1-5)
YQYKGSLYT

SEQ ID NO: 1428 - protein, 11 aa, Homo sapiens
  Heavy chain CDR3 for antibody 714 (IGHV4/OR15-8)
ASRRITVCFDS

SEQ ID NO: 1429 - protein, 9 aa, Homo sapiens
  Light chain CDR3 for antibody 715 (IGKV3-20)
QQYGSSPLT

SEQ ID NO: 1430 - protein, 16 aa, Homo sapiens
  Heavy chain CDR3 for antibody 715 (IGHV4-31)
ARARITMIVVVSHFDY

SEQ ID NO: 1431 - protein, 9 aa, Homo sapiens
  Light chain CDR3 for antibody 716 (IGKV3-20)
QQYGSSLYT

SEQ ID NO: 1432 - protein, 12 aa, Homo sapiens
  Heavy chain CDR3 for antibody 716 (IGHV3-53)
ARDLGSVGATDY

SEQ ID NO: 1433 - protein, 8 aa, Homo sapiens
  Light chain CDR3 for antibody 717 (IGKV3-20)
QQYSSSLT

SEQ ID NO: 1434 - protein, 11 aa, Homo sapiens
  Heavy chain CDR3 for antibody 717 (IGHV1-24)
ATKGGLGELWY

SEQ ID NO: 1435 - protein, 9 aa, Homo sapiens
  Light chain CDR3 for antibody 718 (IGKV1-39)
QQSYSTLLT

SEQ ID NO: 1436 - protein, 13 aa, Homo sapiens
  Heavy chain CDR3 for antibody 718 (IGHV4-b)
ARSPRGDFYYFDY

SEQ ID NO: 1437 - protein, 9 aa, Homo sapiens
  Light chain CDR3 for antibody 719 (IGKV1-39)
QQSYSTLLT

SEQ ID NO: 1438 - protein, 19 aa, Homo sapiens
  Heavy chain CDR3 for antibody 719 (IGHV4/OR15-8)
ARDALGYCSGGRCYAAFDI

SEQ ID NO: 1439 - protein, 8 aa, Homo sapiens
  Light chain CDR3 for antibody 720 (IGKV1-33)
QQYDNLPS

SEQ ID NO: 1440 - protein, 16 aa, Homo sapiens
  Heavy chain CDR3 for antibody 720 (IGHV1-18)
ARANPGAVGYYYGMDV

SEQ ID NO: 1441 - protein, 9 aa, Homo sapiens
  Light chain CDR3 for antibody 721 (IGKV1-33)
QQYDNLPLT

SEQ ID NO: 1442 - protein, 12 aa, Homo sapiens
  Heavy chain CDR3 for antibody 721 (IGHV3-53)
ARDLGSVGATDY

SEQ ID NO: 1443 - protein, 9 aa, Homo sapiens
  Light chain CDR3 for antibody 722 (IGKV3-20)
QQYGSSPDT

SEQ ID NO: 1444 - protein, 11 aa, Homo sapiens
  Heavy chain CDR3 for antibody 722 (IGHV5-51)
ATLDYGGALPY

SEQ ID NO: 1445 - protein, 9 aa, Homo sapiens
  Light chain CDR3 for antibody 723 (IGKV3-20)
QQYGSSLYT

SEQ ID NO: 1446 - protein, 18 aa, Homo sapiens
  Heavy chain CDR3 for antibody 723 (IGHV1-69)
ARGAGIVGAIGRHSFFNY

SEQ ID NO: 1447 - protein, 8 aa, Homo sapiens
  Light chain CDR3 for antibody 724 (IGKV1-33)
QQYDNLPS

SEQ ID NO: 1448 - protein, 13 aa, Homo sapiens
  Heavy chain CDR3 for antibody 724 (IGHV4-31)
ARDYGGNSAQFGY

SEQ ID NO: 1449 - protein, 9 aa, Homo sapiens
  Light chain CDR3 for antibody 725 (IGKV1-39)
QQSYRTSWT

SEQ ID NO: 1450 - protein, 14 aa, Homo sapiens
  Heavy chain CDR3 for antibody 725 (IGHV4-30-2)
ARWSSNHFGALFDS

SEQ ID NO: 1451 - protein, 9 aa, Homo sapiens
  Light chain CDR3 for antibody 726 (IGKV1-33)
QQYDNLPLT

SEQ ID NO: 1452 - protein, 18 aa, Homo sapiens
  Heavy chain CDR3 for antibody 726 (IGHV1-69)
ARGAGIVGAIGRHSFFNY

SEQ ID NO: 1453 - protein, 8 aa, Homo sapiens
  Light chain CDR3 for antibody 727 (IGKV1-5)
QQYNSPYI

SEQ ID NO: 1454 - protein, 10 aa, Homo sapiens
  Heavy chain CDR3 for antibody 727 (IGHV3-53)
ARDRGDSFDI

SEQ ID NO: 1455 - protein, 9 aa, Homo sapiens
  Light chain CDR3 for antibody 728 (IGKV3-20)
QQYGSSPLT

SEQ ID NO: 1456 - protein, 17 aa, Homo sapiens
  Heavy chain CDR3 for antibody 728 (IGHV4-31)
ASANRHTIFGVVGPFDY

SEQ ID NO: 1457 - protein, 9 aa, Homo sapiens
  Light chain CDR3 for antibody 729 (IGKV1-39)
QQSYSTPPT

SEQ ID NO: 1458 - protein, 13 aa, Homo sapiens
  Heavy chain CDR3 for antibody 729 (IGHV4-31)
ARDYGGNSAQFGY

SEQ ID NO: 1459 - protein, 9 aa, Homo sapiens
  Light chain CDR3 for antibody 730 (IGKV1-5)
QHYKNYPLT

SEQ ID NO: 1460 - protein, 14 aa, Homo sapiens
  Heavy chain CDR3 for antibody 730 (IGHV3-72)
AGLVTSPPPYAMDV

SEQ ID NO: 1461 - protein, 9 aa, Homo sapiens
  Light chain CDR3 for antibody 731 (IGKV3-11)
QQRSNWPPT

SEQ ID NO: 1462 - protein, 14 aa, Homo sapiens
  Heavy chain CDR3 for antibody 731 (IGHV3-23)
AKDNAIPTVSWFDP

SEQ ID NO: 1463 - protein, 9 aa, Homo sapiens
  Light chain CDR3 for antibody 732 (IGKV1-16)
QQYNSYPFT

SEQ ID NO: 1464 - protein, 15 aa, Homo sapiens
  Heavy chain CDR3 for antibody 732 (IGHV1-46)
LRGGHHSGLGSPWGY

SEQ ID NO: 1465 - protein, 11 aa, Homo sapiens
  Light chain CDR3 for antibody 733 (IGKV3-15)
QQYNNWPPMYT

SEQ ID NO: 1466 - protein, 11 aa, Homo sapiens
  Heavy chain CDR3 for antibody 733 (IGHV3-53)
ARDGRGDLWSY

SEQ ID NO: 1467 - protein, 8 aa, Homo sapiens
  Light chain CDR3 for antibody 734 (IGKV1-33)
QQYDNLPS

SEQ ID NO: 1468 - protein, 11 aa, Homo sapiens
  Heavy chain CDR3 for antibody 734 (IGHV3-53)
ARDLQVYGMDV

SEQ ID NO: 1469 - protein, 9 aa, Homo sapiens
  Light chain CDR3 for antibody 735 (IGKV1-39)
QQSYSTPPT

SEQ ID NO: 1470 - protein, 11 aa, Homo sapiens
  Heavy chain CDR3 for antibody 735 (IGHV3-53)
ARDGRGDLWSY

SEQ ID NO: 1471 - protein, 8 aa, Homo sapiens
  Light chain CDR3 for antibody 736 (IGKV3-11)
QQRSNWLT

SEQ ID NO: 1472 - protein, 16 aa, Homo sapiens
  Heavy chain CDR3 for antibody 736 (IGHV4-31)
ARASRGIFGVVEWSDP

SEQ ID NO: 1473 - protein, 9 aa, Homo sapiens
  Light chain CDR3 for antibody 737 (IGKV2D-28)
MQALQTPPT

SEQ ID NO: 1474 - protein, 11 aa, Homo sapiens
  Heavy chain CDR3 for antibody 737 (IGHV1-69)
NGRGELGYFDY

SEQ ID NO: 1475 - protein, 8 aa, Homo sapiens
  Light chain CDR3 for antibody 738 (IGKV3-20)
QQYGSSPQ

SEQ ID NO: 1476 - protein, 22 aa, Homo sapiens
  Heavy chain CDR3 for antibody 738 (IGHV1-f)
VRGSSGWTKWGVGPYYYYFMDV

SEQ ID NO: 1477 - protein, 9 aa, Homo sapiens
  Light chain CDR3 for antibody 739 (IGKV3-20)
QQYGSSPLT

SEQ ID NO: 1478 - protein, 11 aa, Homo sapiens
  Heavy chain CDR3 for antibody 739 (IGHV3-53)
ARDGRGDLWSY

SEQ ID NO: 1479 - protein, 11 aa, Homo sapiens
  Light chain CDR3 for antibody 740 (IGKV3-15)
QQYNNWPPMYT

SEQ ID NO: 1480 - protein, 19 aa, Homo sapiens
  Heavy chain CDR3 for antibody 740 (IGHV1-69)
ARAHRSSTSYRLGINWFDP

SEQ ID NO: 1481 - protein, 9 aa, Homo sapiens
  Light chain CDR3 for antibody 741 (IGKV1-39)
QQSYSTPIT

SEQ ID NO: 1482 - protein, 9 aa, Homo sapiens
  Heavy chain CDR3 for antibody 741 (IGHV5-51)
ARLIELADY

SEQ ID NO: 1483 - protein, 9 aa, Homo sapiens
  Light chain CDR3 for antibody 742 (IGKV1-39)
QQSYSTPPT

SEQ ID NO: 1484 - protein, 20 aa, Homo sapiens
  Heavy chain CDR3 for antibody 742 (IGHV4-39)
ARTGHLIRFLEWLPINWFDP

SEQ ID NO: 1485 - protein, 8 aa, Homo sapiens
  Light chain CDR3 for antibody 743 (IGKV1-39)
QQTFSGGS

SEQ ID NO: 1486 - protein, 17 aa, Homo sapiens
  Heavy chain CDR3 for antibody 743 (IGHV1/OR15-1)
ATGPPGGSSSAGYYLDS

SEQ ID NO: 1487 - protein, 9 aa, Homo sapiens
  Light chain CDR3 for antibody 744 (IGKV1-39)
QQSYSTPPT

SEQ ID NO: 1488 - protein, 12 aa, Homo sapiens
  Heavy chain CDR3 for antibody 744 (IGHV3-53)
ARDLGSVGATDY

SEQ ID NO: 1489 - protein, 9 aa, Homo sapiens
  Light chain CDR3 for antibody 745 (IGKV1-9)
QQLNSYPPP

SEQ ID NO: 1490 - protein, 12 aa, Homo sapiens
  Heavy chain CDR3 for antibody 745 (IGHV3-53)
ARDLGSVGATDY

SEQ ID NO: 1491 - protein, 9 aa, Homo sapiens
  Light chain CDR3 for antibody 746 (IGKV3-20)
QQYGSSPQT

SEQ ID NO: 1492 - protein, 11 aa, Homo sapiens
  Heavy chain CDR3 for antibody 746 (IGHV6-1)
SRVVAAAGTDY

SEQ ID NO: 1493 - protein, 11 aa, Homo sapiens
  Light chain CDR3 for antibody 747 (IGKV3-15)
QQYNNWPPMYT

SEQ ID NO: 1494 - protein, 13 aa, Homo sapiens
  Heavy chain CDR3 for antibody 747 (IGHV4-31)
ARDYGGNSAQFGY

SEQ ID NO: 1495 - protein, 10 aa, Homo sapiens
  Light chain CDR3 for antibody 748 (IGKV3-11)
QQRSNWPPLT

SEQ ID NO: 1496 - protein, 14 aa, Homo sapiens
  Heavy chain CDR3 for antibody 748 (IGHV1-8)
ARGFGGWGNYYMDV

SEQ ID NO: 1497 - protein, 10 aa, Homo sapiens
  Light chain CDR3 for antibody 749 (IGKV3-11)
QQRSTWPPYT

SEQ ID NO: 1498 - protein, 11 aa, Homo sapiens
  Heavy chain CDR3 for antibody 749 (IGHV1-2)
VKGRRGYSAEY

SEQ ID NO: 1499 - protein, 8 aa, Homo sapiens
  Light chain CDR3 for antibody 750 (IGKV3-15)
QQYIKLLS

SEQ ID NO: 1500 - protein, 12 aa, Homo sapiens
  Heavy chain CDR3 for antibody 750 (IGHV3-73)
SRGSEGNWFYDL

SEQ ID NO: 1501 - protein, 9 aa, Homo sapiens
  Light chain CDR3 for antibody 751 (IGKV1-9)
QQLNSYPPP

SEQ ID NO: 1502 - protein, 11 aa, Homo sapiens
  Heavy chain CDR3 for antibody 751 (IGHV3-53)
ARDGRGDLWSY

SEQ ID NO: 1503 - protein, 9 aa, Homo sapiens
  Light chain CDR3 for antibody 752 (IGKV1-17)
LQHNSYPLT

SEQ ID NO: 1504 - protein, 14 aa, Homo sapiens
  Heavy chain CDR3 for antibody 752 (IGHV1-18)
ATGPVVVGPDYFDS

SEQ ID NO: 1505 - protein, 9 aa, Homo sapiens
  Light chain CDR3 for antibody 753 (IGKV1-33)
QQYDNLPPT

SEQ ID NO: 1506 - protein, 16 aa, Homo sapiens
  Heavy chain CDR3 for antibody 753 (IGHV5-51)
ARPFTSGSSGWYAIDY

SEQ ID NO: 1507 - protein, 9 aa, Homo sapiens
  Light chain CDR3 for antibody 754 (IGKV1-9)
QQLTSYSYT

SEQ ID NO: 1508 - protein, 19 aa, Homo sapiens
  Heavy chain CDR3 for antibody 754 (IGHV1-69)
ARAHRSSTSYRLGINWFDP

SEQ ID NO: 1509 - protein, 9 aa, Homo sapiens
  Light chain CDR3 for antibody 755 (IGKV3-20)
QQYGSSPWT

SEQ ID NO: 1510 - protein, 6 aa, Homo sapiens
  Heavy chain CDR3 for antibody 755 (IGHV4-59)
AREFDY

SEQ ID NO: 1511 - protein, 6 aa, Homo sapiens
  Light chain CDR3 for antibody 756 (IGKV3-20)
QQYGST

SEQ ID NO: 1512 - protein, 16 aa, Homo sapiens
  Heavy chain CDR3 for antibody 756 (IGHV5-a)
ARHWSPVVVRGSEPDY

SEQ ID NO: 1513 - protein, 9 aa, Homo sapiens
  Light chain CDR3 for antibody 757 (IGKV1-39)
QQTNSLPRT

SEQ ID NO: 1514 - protein, 20 aa, Homo sapiens
  Heavy chain CDR3 for antibody 757 (IGHV4-34)
ARGIPGGISPTGAPLSWLDP

SEQ ID NO: 1515 - protein, 11 aa, Homo sapiens
  Light chain CDR3 for antibody 758 (IGKV3-15)
QQYNNWPPMYT

SEQ ID NO: 1516 - protein, 20 aa, Homo sapiens
  Heavy chain CDR3 for antibody 758 (IGHV4-39)
ARTGHLIRFLEWLPINWFDP

SEQ ID NO: 1517 - protein, 9 aa, Homo sapiens
  Light chain CDR3 for antibody 759 (IGKV1-9)
QQLNSYPQT

SEQ ID NO: 1518 - protein, 18 aa, Homo sapiens
  Heavy chain CDR3 for antibody 759 (IGHV1-69)
ARGAGIVGAIGRHSFFNY

SEQ ID NO: 1519 - protein, 9 aa, Homo sapiens
  Light chain CDR3 for antibody 760 (IGKV3-20)
QQYGSSLYT

SEQ ID NO: 1520 - protein, 13 aa, Homo sapiens
  Heavy chain CDR3 for antibody 760 (IGHV5-51)
ARRYSGFHAELDY

SEQ ID NO: 1521 - protein, 9 aa, Homo sapiens
  Light chain CDR3 for antibody 761 (IGKV1-16)
QQYNSYPLT

SEQ ID NO: 1522 - protein, 22 aa, Homo sapiens
  Heavy chain CDR3 for antibody 761 (IGHV4-34)
ARGRYSSSWYDRVSYYYYGMDV

SEQ ID NO: 1523 - protein, 9 aa, Homo sapiens
  Light chain CDR3 for antibody 762 (IGKV3-20)
QQYGSSLWT

SEQ ID NO: 1524 - protein, 13 aa, Homo sapiens
  Heavy chain CDR3 for antibody 762 (IGHV2-70)
ARIGIQLWPHFDY

SEQ ID NO: 1525 - protein, 11 aa, Homo sapiens
  Light chain CDR3 for antibody 763 (IGKV3-20)
QLFTNSPPMYT

SEQ ID NO: 1526 - protein, 10 aa, Homo sapiens
  Heavy chain CDR3 for antibody 763 (IGHV4-30-2)
ARNGGYDQDI

SEQ ID NO: 1527 - protein, 9 aa, Homo sapiens
  Light chain CDR3 for antibody 764 (IGKV3-20)
QQYGSSPLT

SEQ ID NO: 1528 - protein, 16 aa, Homo sapiens
  Heavy chain CDR3 for antibody 764 (IGHV4-31)
ARGHTIFGVVANPFDY

SEQ ID NO: 1529 - protein, 9 aa, Homo sapiens
  Light chain CDR3 for antibody 765 (IGKV1-12)
QQANSFPYT

SEQ ID NO: 1530 - protein, 11 aa, Homo sapiens
  Heavy chain CDR3 for antibody 765 (IGHV3-53)
ARDLGPYGMDV

SEQ ID NO: 1531 - protein, 9 aa, Homo sapiens
  Light chain CDR3 for antibody 766 (IGKV1D-17)
LQHYTYPFT

SEQ ID NO: 1532 - protein, 16 aa, Homo sapiens
  Heavy chain CDR3 for antibody 766 (IGHV3-21)
TTDRPGFCSDGSCWET

SEQ ID NO: 1533 - protein, 9 aa, Homo sapiens
  Light chain CDR3 for antibody 767 (IGKV1-9)
QQLNSYPPP

SEQ ID NO: 1534 - protein, 16 aa, Homo sapiens
  Heavy chain CDR3 for antibody 767 (IGHV1-18)
ARANPGAVGYYYGMDV

SEQ ID NO: 1535 - protein, 9 aa, Homo sapiens
  Light chain CDR3 for antibody 768 (IGKV1-39)
QQSHATPWA

SEQ ID NO: 1536 - protein, 11 aa, Homo sapiens
  Heavy chain CDR3 for antibody 768 (IGHV4-28)
ARAYGKVAFDY

SEQ ID NO: 1537 - protein, 8 aa, Homo sapiens
  Light chain CDR3 for antibody 769 (IGKV1-9)
QQLNSYPA

SEQ ID NO: 1538 - protein, 18 aa, Homo sapiens
  Heavy chain CDR3 for antibody 769 (IGHV1-69)
ARGGWSSSSGLNYYGMDV

SEQ ID NO: 1539 - protein, 9 aa, Homo sapiens
  Light chain CDR3 for antibody 770 (IGKV3-20)
QQYGSSPWT

SEQ ID NO: 1540 - protein, 16 aa, Homo sapiens
  Heavy chain CDR3 for antibody 770 (IGHV4-34)
ARVPYRAASRNGAFDI

SEQ ID NO: 1541 - protein, 9 aa, Homo sapiens
  Light chain CDR3 for antibody 771 (IGKV1-5)
QQYNSYPWT

SEQ ID NO: 1542 - protein, 12 aa, Homo sapiens
  Heavy chain CDR3 for antibody 771 (IGHV3-33)
ARCLSYYYGMDV

SEQ ID NO: 1543 - protein, 9 aa, Homo sapiens
  Light chain CDR3 for antibody 772 (IGKV3-11)
QQRRNWPLT

SEQ ID NO: 1544 - protein, 14 aa, Homo sapiens
  Heavy chain CDR3 for antibody 772 (IGHV3-30)
ARVGYGNYYYGMDV

SEQ ID NO: 1545 - protein, 8 aa, Homo sapiens
  Light chain CDR3 for antibody 773 (IGKV1-33)
QQYDNLPS

SEQ ID NO: 1546 - protein, 9 aa, Homo sapiens
  Heavy chain CDR3 for antibody 773 (IGHV3-53)
ARESYGMDV

SEQ ID NO: 1547 - protein, 9 aa, Homo sapiens
  Light chain CDR3 for antibody 774 (IGKV1-12)
QQANSFPIT

SEQ ID NO: 1548 - protein, 14 aa, Homo sapiens
  Heavy chain CDR3 for antibody 774 (IGHV3-49)
TTTANWGFRWYFDL

SEQ ID NO: 1549 - protein, 9 aa, Homo sapiens
  Light chain CDR3 for antibody 775 (IGKV1-33)
QQYDNLPLT

SEQ ID NO: 1550 - protein, 17 aa, Homo sapiens
  Heavy chain CDR3 for antibody 775 (IGHV4-31)
ASANRHTIFGVVGPFDY

SEQ ID NO: 1551 - protein, 9 aa, Homo sapiens
  Light chain CDR3 for antibody 776 (IGKV3-11)
QQRSNWPRT

SEQ ID NO: 1552 - protein, 23 aa, Homo sapiens
  Heavy chain CDR3 for antibody 776 (IGHV1-8)
ARVRARFTMIVVVPHYYYYGMDV

SEQ ID NO: 1553 - protein, 9 aa, Homo sapiens
  Light chain CDR3 for antibody 777 (IGKV2D-28)
MQALQTLFT

SEQ ID NO: 1554 - protein, 13 aa, Homo sapiens
  Heavy chain CDR3 for antibody 777 (IGHV2-5)
AHSRAWFGEPVSY

SEQ ID NO: 1555 - protein, 9 aa, Homo sapiens
  Light chain CDR3 for antibody 778 (IGKV1-39)
QQTNSLPRT

SEQ ID NO: 1556 - protein, 13 aa, Homo sapiens
  Heavy chain CDR3 for antibody 778 (IGHV3-15)
STEAYYEPNIVHG

SEQ ID NO: 1557 - protein, 9 aa, Homo sapiens
  Light chain CDR3 for antibody 779 (IGKV2D-28)
MQGLEAPWT

SEQ ID NO: 1558 - protein, 16 aa, Homo sapiens
  Heavy chain CDR3 for antibody 779 (IGHV3-74)
ARGQRDPNYHYHGADV

SEQ ID NO: 1559 - protein, 8 aa, Homo sapiens
  Light chain CDR3 for antibody 780 (IGKV1-33)
QQYDNLPS

SEQ ID NO: 1560 - protein, 11 aa, Homo sapiens
  Heavy chain CDR3 for antibody 780 (IGHV3-53)
ARDGRGDLWSY

SEQ ID NO: 1561 - protein, 10 aa, Homo sapiens
  Light chain CDR3 for antibody 781 (IGKV1-39)
QQSYSTPPWT

SEQ ID NO: 1562 - protein, 16 aa, Homo sapiens
  Heavy chain CDR3 for antibody 781 (IGHV3-13)
ARGRTPAASFYYYMDV

SEQ ID NO: 1563 - protein, 9 aa, Homo sapiens
  Light chain CDR3 for antibody 782 (IGKV3-20)
QQYGSSLYT

SEQ ID NO: 1564 - protein, 19 aa, Homo sapiens
  Heavy chain CDR3 for antibody 782 (IGHV1-58)
AANRPVDTAMVTYYYGMDV

SEQ ID NO: 1565 - protein, 9 aa, Homo sapiens
  Light chain CDR3 for antibody 783 (IGKV1-9)
QQLNSYSYT

SEQ ID NO: 1566 - protein, 14 aa, Homo sapiens
  Heavy chain CDR3 for antibody 783 (IGHV3-23)
AKALAAAGYDAFDI

SEQ ID NO: 1567 - protein, 10 aa, Homo sapiens
  Light chain CDR3 for antibody 784 (IGKV1-39)
QQSYSTPALT

SEQ ID NO: 1568 - protein, 22 aa, Homo sapiens
  Heavy chain CDR3 for antibody 784 (IGHV1-18)
ARDQGNWNYVGWGIQQYNWFDP

SEQ ID NO: 1569 - protein, 9 aa, Homo sapiens
  Light chain CDR3 for antibody 785 (IGKV3-20)
QQYGSSPLT

SEQ ID NO: 1570 - protein, 16 aa, Homo sapiens
  Heavy chain CDR3 for antibody 785 (IGHV1-18)
ARANPGAVGYYYGMDV

SEQ ID NO: 1571 - protein, 10 aa, Homo sapiens
  Light chain CDR3 for antibody 786 (IGKV3-11)
QQRSNWPPPT

SEQ ID NO: 1572 - protein, 12 aa, Homo sapiens
  Heavy chain CDR3 for antibody 786 (IGHV3-21)
ARGAYGKGPFEY

SEQ ID NO: 1573 - protein, 9 aa, Homo sapiens
  Light chain CDR3 for antibody 787 (IGKV1D-12)
QQASSFPYT

SEQ ID NO: 1574 - protein, 20 aa, Homo sapiens
  Heavy chain CDR3 for antibody 787 (IGHV3-48)
ARRPDFDFWSGTTLAYGMDV

SEQ ID NO: 1575 - protein, 9 aa, Homo sapiens
  Light chain CDR3 for antibody 788 (IGKV3-20)
QQYGNSPWA

SEQ ID NO: 1576 - protein, 7 aa, Homo sapiens
  Heavy chain CDR3 for antibody 788 (IGHV3-15)
RGSYLGN

SEQ ID NO: 1577 - protein, 9 aa, Homo sapiens
  Light chain CDR3 for antibody 789 (IGKV3-11)
QQRSDWRLT

SEQ ID NO: 1578 - protein, 16 aa, Homo sapiens
  Heavy chain CDR3 for antibody 789 (IGHV1-69)
ASDILRPRGAGYYFDD

SEQ ID NO: 1579 - protein, 9 aa, Homo sapiens
  Light chain CDR3 for antibody 790 (IGKV1-NL1)
QQYYSTPWT

SEQ ID NO: 1580 - protein, 13 aa, Homo sapiens
  Heavy chain CDR3 for antibody 790 (IGHV3-9)
AKGYGFTTYYMDV

SEQ ID NO: 1581 - protein, 9 aa, Homo sapiens
  Light chain CDR3 for antibody 791 (IGKV3-20)
QEHGGSLYT

SEQ ID NO: 1582 - protein, 14 aa, Homo sapiens
  Heavy chain CDR3 for antibody 791 (IGHV5-a)
AIWRGIFYYYGMDV

SEQ ID NO: 1583 - protein, 9 aa, Homo sapiens
  Light chain CDR3 for antibody 792 (IGKV1-12)
QQANSFPIT

SEQ ID NO: 1584 - protein, 16 aa, Homo sapiens
  Heavy chain CDR3 for antibody 792 (IGHV1-18)
ARTWIQLYYYYYYMDV

SEQ ID NO: 1585 - protein, 10 aa, Homo sapiens
  Light chain CDR3 for antibody 793 (IGKV3-11)
QQRDNWPPIT

SEQ ID NO: 1586 - protein, 16 aa, Homo sapiens
  Heavy chain CDR3 for antibody 793 (IGHV3-33)
VGDSGVAGRRGNYFDP

SEQ ID NO: 1587 - protein, 8 aa, Homo sapiens
  Light chain CDR3 for antibody 794 (IGKV3-20)
QQYGSSPP

SEQ ID NO: 1588 - protein, 19 aa, Homo sapiens
  Heavy chain CDR3 for antibody 794 (IGHV1-69)
ARGGWGTVVTPRGYYYMDV

SEQ ID NO: 1589 - protein, 9 aa, Homo sapiens
  Light chain CDR3 for antibody 795 (IGKV3-20)
QQYGSSPWT

SEQ ID NO: 1590 - protein, 18 aa, Homo sapiens
  Heavy chain CDR3 for antibody 795 (IGHV4-34)
ARGRAVTTFFMSDNWFDP

SEQ ID NO: 1591 - protein, 11 aa, Homo sapiens
  Light chain CDR3 for antibody 796 (IGKV3-15)
QQYNNWPPVYT

SEQ ID NO: 1592 - protein, 9 aa, Homo sapiens
  Heavy chain CDR3 for antibody 796 (IGHV4/OR15-8)
ARRWGSSDV

SEQ ID NO: 1593 - protein, 10 aa, Homo sapiens
  Light chain CDR3 for antibody 797 (IGKV3-20)
QQYGSSPPDT

SEQ ID NO: 1594 - protein, 16 aa, Homo sapiens
  Heavy chain CDR3 for antibody 797 (IGHV1-18)
ARANPGAVGYYYGMDV

SEQ ID NO: 1595 - protein, 9 aa, Homo sapiens
  Light chain CDR3 for antibody 798 (IGKV1-6)
LQDYNDPPT

SEQ ID NO: 1596 - protein, 13 aa, Homo sapiens
  Heavy chain CDR3 for antibody 798 (IGHV3-53)
ARDTRHMGGGADV

SEQ ID NO: 1597 - protein, 10 aa, Homo sapiens
  Light chain CDR3 for antibody 799 (IGKV1-33)
QQYDNLPRLT

SEQ ID NO: 1598 - protein, 13 aa, Homo sapiens
  Heavy chain CDR3 for antibody 799 (IGHV5-51)
ARRSMIVVDAFDI

SEQ ID NO: 1599 - protein, 8 aa, Homo sapiens
  Light chain CDR3 for antibody 800 (IGKV3-15)
QQYNNWPT

SEQ ID NO: 1600 - protein, 19 aa, Homo sapiens
  Heavy chain CDR3 for antibody 800 (IGHV1-69)
ARAHRSSTSYRLGINWFDP

SEQ ID NO: 1601 - protein, 9 aa, Homo sapiens
  Light chain CDR3 for antibody 801 (IGKV1-9)
QQLNSYSYT

SEQ ID NO: 1602 - protein, 13 aa, Homo sapiens
  Heavy chain CDR3 for antibody 801 (IGHV5-51)
ARRYSGFHAELDY

SEQ ID NO: 1603 - protein, 9 aa, Homo sapiens
  Light chain CDR3 for antibody 802 (IGKV1-9)
QQLNSYSYT

SEQ ID NO: 1604 - protein, 12 aa, Homo sapiens
  Heavy chain CDR3 for antibody 802 (IGHV2-5)
GYRGGARAWFGP

SEQ ID NO: 1605 - protein, 9 aa, Homo sapiens
  Light chain CDR3 for antibody 803 (IGKV3-20)
QHYGSSPWT

SEQ ID NO: 1606 - protein, 13 aa, Homo sapiens
  Heavy chain CDR3 for antibody 803 (IGHV2-26)
ARASYSAAGLFDS

SEQ ID NO: 1607 - protein, 9 aa, Homo sapiens
  Light chain CDR3 for antibody 804 (IGKV1-27)
QKYNTFSWT

SEQ ID NO: 1608 - protein, 13 aa, Homo sapiens
  Heavy chain CDR3 for antibody 804 (IGHV1-69)
ARPVVGSGSNFDY

SEQ ID NO: 1609 - protein, 9 aa, Homo sapiens
  Light chain CDR3 for antibody 805 (IGKV3-11)
QQRRNWPLT

SEQ ID NO: 1610 - protein, 11 aa, Homo sapiens
  Heavy chain CDR3 for antibody 805 (IGHV3-53)
ARDLQVYGMDV

SEQ ID NO: 1611 - protein, 9 aa, Homo sapiens
  Light chain CDR3 for antibody 806 (IGKV3-20)
QEHGGSLYT

SEQ ID NO: 1612 - protein, 12 aa, Homo sapiens
  Heavy chain CDR3 for antibody 806 (IGHV1-2)
ARGNANWRPFDH

SEQ ID NO: 1613 - protein, 9 aa, Homo sapiens
  Light chain CDR3 for antibody 807 (IGKV1-6)
LQDYNYPRT

SEQ ID NO: 1614 - protein, 8 aa, Homo sapiens
  Heavy chain CDR3 for antibody 807 (IGHV4-34)
ARTGGMDV

SEQ ID NO: 1615 - protein, 9 aa, Homo sapiens
  Light chain CDR3 for antibody 808 (IGKV1-39)
QQSYSTLLT

SEQ ID NO: 1616 - protein, 10 aa, Homo sapiens
  Heavy chain CDR3 for antibody 808 (IGHV3-53)
ARDRGDSFDI

SEQ ID NO: 1617 - protein, 9 aa, Homo sapiens
  Light chain CDR3 for antibody 809 (IGKV1-39)
QQSYSTPGT

SEQ ID NO: 1618 - protein, 11 aa, Homo sapiens
  Heavy chain CDR3 for antibody 809 (IGHV3-53)
ARDLGPYGMDV

SEQ ID NO: 1619 - protein, 9 aa, Homo sapiens
  Light chain CDR3 for antibody 810 (IGKV3-11)
QHRNEVPLT

SEQ ID NO: 1620 - protein, 10 aa, Homo sapiens
  Heavy chain CDR3 for antibody 810 (IGHV4-39)
ARDAGGSGNN

SEQ ID NO: 1621 - protein, 9 aa, Homo sapiens
  Light chain CDR3 for antibody 811 (IGKV3-20)
QQYGSSLYT

SEQ ID NO: 1622 - protein, 15 aa, Homo sapiens
  Heavy chain CDR3 for antibody 811 (IGHV1-69)
ARGGDGYNLVAHYDY

SEQ ID NO: 1623 - protein, 9 aa, Homo sapiens
  Light chain CDR3 for antibody 812 (IGKV1-39)
QQSYSTPPT

SEQ ID NO: 1624 - protein, 13 aa, Homo sapiens
  Heavy chain CDR3 for antibody 812 (IGHV5-51)
ARRYSGFHAELDY

SEQ ID NO: 1625 - protein, 9 aa, Homo sapiens
  Light chain CDR3 for antibody 813 (IGKV1-39)
QQSYSTPPT

SEQ ID NO: 1626 - protein, 19 aa, Homo sapiens
  Heavy chain CDR3 for antibody 813 (IGHV1-69)
ARAHRSSTGCRLGINWFDA

SEQ ID NO: 1627 - protein, 8 aa, Homo sapiens
  Light chain CDR3 for antibody 814 (IGKV3-11)
QQRIYWWT

SEQ ID NO: 1628 - protein, 17 aa, Homo sapiens
  Heavy chain CDR3 for antibody 814 (IGHV3-66)
AREDWNDRDVRYDWFDP

SEQ ID NO: 1629 - protein, 9 aa, Homo sapiens
  Light chain CDR3 for antibody 815 (IGKV3-11)
QQRRNWPLT

SEQ ID NO: 1630 - protein, 9 aa, Homo sapiens
  Heavy chain CDR3 for antibody 815 (IGHV3-53)
ARESYGMDV

SEQ ID NO: 1631 - protein, 8 aa, Homo sapiens
  Light chain CDR3 for antibody 816 (IGKV1-33)
QQYDNLPL

SEQ ID NO: 1632 - protein, 15 aa, Homo sapiens
  Heavy chain CDR3 for antibody 816 (IGHV3-20)
ASSYSSSWYIPRFDP

SEQ ID NO: 1633 - protein, 8 aa, Homo sapiens
  Light chain CDR3 for antibody 817 (IGKV3-15)
QQYNNWPT

SEQ ID NO: 1634 - protein, 16 aa, Homo sapiens
  Heavy chain CDR3 for antibody 817 (IGHV1-18)
ARANPGAVGYYYGMDV

SEQ ID NO: 1635 - protein, 9 aa, Homo sapiens
  Light chain CDR3 for antibody 818 (IGKV3-20)
QQYGSSPLT

SEQ ID NO: 1636 - protein, 17 aa, Homo sapiens
  Heavy chain CDR3 for antibody 818 (IGHV4-31)
ARVERITIFGVVSAVDY

SEQ ID NO: 1637 - protein, 9 aa, Homo sapiens
  Light chain CDR3 for antibody 819 (IGKV1-9)
QQLNSYPQT

SEQ ID NO: 1638 - protein, 11 aa, Homo sapiens
  Heavy chain CDR3 for antibody 819 (IGHV3-53)
ARDGRGDRWSY

SEQ ID NO: 1639 - protein, 9 aa, Homo sapiens
  Light chain CDR3 for antibody 820 (IGKV3-20)
QQYGSSPLT

SEQ ID NO: 1640 - protein, 15 aa, Homo sapiens
  Heavy chain CDR3 for antibody 820 (IGHV4-31)
ARAPKYIVVVTHFDY

SEQ ID NO: 1641 - protein, 9 aa, Homo sapiens
  Light chain CDR3 for antibody 821 (IGKV3-20)
QQYGSSPLT

SEQ ID NO: 1642 - protein, 11 aa, Homo sapiens
  Heavy chain CDR3 for antibody 821 (IGHV3-53)
ARDLGPYGMDV

SEQ ID NO: 1643 - protein, 10 aa, Homo sapiens
  Light chain CDR3 for antibody 822 (IGKV3-20)
QQSYSTPALT

SEQ ID NO: 1644 - protein, 18 aa, Homo sapiens
  Heavy chain CDR3 for antibody 822 (IGHV4/OR15-8)
ARVDSAWAGTPRFWYFDL

SEQ ID NO: 1645 - protein, 8 aa, Homo sapiens
  Light chain CDR3 for antibody 823 (IGKV1-33)
QQYDNLPS

SEQ ID NO: 1646 - protein, 20 aa, Homo sapiens
  Heavy chain CDR3 for antibody 823 (IGHV4-39)
ARTGHLIRFLEWLPINWFDP

SEQ ID NO: 1647 - protein, 8 aa, Homo sapiens
  Light chain CDR3 for antibody 824 (IGKV3-20)
QQYGSSRT

SEQ ID NO: 1648 - protein, 15 aa, Homo sapiens
  Heavy chain CDR3 for antibody 824 (IGHV1-69)
ARFANYYDSRTGIDY

SEQ ID NO: 1649 - protein, 8 aa, Homo sapiens
  Light chain CDR3 for antibody 825 (IGKV1-33)
QQYDNRLT

SEQ ID NO: 1650 - protein, 13 aa, Homo sapiens
  Heavy chain CDR3 for antibody 825 (IGHV1-69)
ARPVVGSGSNFDY

SEQ ID NO: 1651 - protein, 8 aa, Homo sapiens
  Light chain CDR3 for antibody 826 (IGKV1-33)
QQYDNLPS

SEQ ID NO: 1652 - protein, 12 aa, Homo sapiens
  Heavy chain CDR3 for antibody 826 (IGHV3-53)
ARDLGSVGATDY

SEQ ID NO: 1653 - protein, 9 aa, Homo sapiens
  Light chain CDR3 for antibody 827 (IGKV1-39)
QQSYSTYGT

SEQ ID NO: 1654 - protein, 16 aa, Homo sapiens
  Heavy chain CDR3 for antibody 827 (IGHV3-11)
ARRHGDYVQFYDGMDV

SEQ ID NO: 1655 - protein, 9 aa, Homo sapiens
  Light chain CDR3 for antibody 828 (IGKV3-15)
QQLNSYPPP

SEQ ID NO: 1656 - protein, 13 aa, Homo sapiens
  Heavy chain CDR3 for antibody 828 (IGHV4-31)
ARDYGGNSAQFGY

SEQ ID NO: 1657 - protein, 9 aa, Homo sapiens
  Light chain CDR3 for antibody 829 (IGKV1-33)
QQYDNLPLT

SEQ ID NO: 1658 - protein, 11 aa, Homo sapiens
  Heavy chain CDR3 for antibody 829 (IGHV3-53)
ARDGRGDPLYY

SEQ ID NO: 1659 - protein, 9 aa, Homo sapiens
  Light chain CDR3 for antibody 830 (IGKV1-33)
QQYDNLPLT

SEQ ID NO: 1660 - protein, 16 aa, Homo sapiens
  Heavy chain CDR3 for antibody 830 (IGHV4-31)
ARARITMIVVVSHFDY

SEQ ID NO: 1661 - protein, 9 aa, Homo sapiens
  Light chain CDR3 for antibody 831 (IGKV1-5)
QQYNSYPWT

SEQ ID NO: 1662 - protein, 18 aa, Homo sapiens
  Heavy chain CDR3 for antibody 831 (IGHV1-69)
ARVFADVDTAMVEYYFDY

SEQ ID NO: 1663 - protein, 10 aa, Homo sapiens
  Light chain CDR3 for antibody 832 (IGKV3-20)
QQYGSSPPDT

SEQ ID NO: 1664 - protein, 20 aa, Homo sapiens
  Heavy chain CDR3 for antibody 832 (IGHV4-39)
ARTGHLIRFLEWLPINWFDP

SEQ ID NO: 1665 - protein, 9 aa, Homo sapiens
  Light chain CDR3 for antibody 833 (IGKV1-39)
QQSYSTPLT

SEQ ID NO: 1666 - protein, 16 aa, Homo sapiens
  Heavy chain CDR3 for antibody 833 (IGHV4-31)
ARAVHTIFGVVSHFDY

SEQ ID NO: 1667 - protein, 10 aa, Homo sapiens
  Light chain CDR3 for antibody 834 (IGKV1-33)
QQYDNLPMYT

SEQ ID NO: 1668 - protein, 21 aa, Homo sapiens
  Heavy chain CDR3 for antibody 834 (IGHV4-31)
ARDGGEFLEWLSSRGPGWFDP

SEQ ID NO: 1669 - protein, 9 aa, Homo sapiens
  Light chain CDR3 for antibody 835 (IGKV3-20)
QQYGSSLYT

SEQ ID NO: 1670 - protein, 11 aa, Homo sapiens
  Heavy chain CDR3 for antibody 835 (IGHV1-24)
ATKGGLGELWY

SEQ ID NO: 1671 - protein, 10 aa, Homo sapiens
  Light chain CDR3 for antibody 836 (IGKV3-20)
QQYGSSPPDT

SEQ ID NO: 1672 - protein, 19 aa, Homo sapiens
  Heavy chain CDR3 for antibody 836 (IGHV1-69)
ARAHRSSTSYRLGINWFDP

SEQ ID NO: 1673 - protein, 8 aa, Homo sapiens
  Light chain CDR3 for antibody 837 (IGKV3-15)
QQYNNWPT

SEQ ID NO: 1674 - protein, 9 aa, Homo sapiens
  Heavy chain CDR3 for antibody 837 (IGHV3-53)
ARESYGMDV

SEQ ID NO: 1675 - protein, 9 aa, Homo sapiens
  Light chain CDR3 for antibody 838 (IGKV3-20)
QQYGSSLLT

SEQ ID NO: 1676 - protein, 13 aa, Homo sapiens
  Heavy chain CDR3 for antibody 838 (IGHV1-46)
ARAGTYYYYYMDV

SEQ ID NO: 1677 - protein, 9 aa, Homo sapiens
  Light chain CDR3 for antibody 839 (IGKV1-39)
QQSYSTPRT

SEQ ID NO: 1678 - protein, 16 aa, Homo sapiens
  Heavy chain CDR3 for antibody 839 (IGHV4-31)
ARARITMIVVVSHFDY

SEQ ID NO: 1679 - protein, 10 aa, Homo sapiens
  Light chain CDR3 for antibody 840 (IGKV3-11)
QQRSNWPSAV

SEQ ID NO: 1680 - protein, 18 aa, Homo sapiens
  Heavy chain CDR3 for antibody 840 (IGHV4-34)
ARGPYSSSWYGEKYYFDY

SEQ ID NO: 1681 - protein, 9 aa, Homo sapiens
  Light chain CDR3 for antibody 841 (IGKV1-39)
QQSYSTPPT

SEQ ID NO: 1682 - protein, 16 aa, Homo sapiens
  Heavy chain CDR3 for antibody 841 (IGHV1-18)
ARTWIQLYYYYYYMDV

SEQ ID NO: 1683 - protein, 9 aa, Homo sapiens
  Light chain CDR3 for antibody 842 (IGKV1-39)
QQSYSMPRA

SEQ ID NO: 1684 - protein, 17 aa, Homo sapiens
  Heavy chain CDR3 for antibody 842 (IGHV1-18)
ARDYYGGNSVVLGGFDI

SEQ ID NO: 1685 - protein, 10 aa, Homo sapiens
  Light chain CDR3 for antibody 843 (IGKV1-39)
QQSYSLPPFT

SEQ ID NO: 1686 - protein, 15 aa, Homo sapiens
  Heavy chain CDR3 for antibody 843 (IGHV4-61)
ARGTYNYGLGPWFDP

SEQ ID NO: 1687 - protein, 9 aa, Homo sapiens
  Light chain CDR3 for antibody 844 (IGKV1-33)
QQYDNLPLT

SEQ ID NO: 1688 - protein, 20 aa, Homo sapiens
  Heavy chain CDR3 for antibody 844 (IGHV3-30)
AKGQGPYCSGGSCYGSYFDY

SEQ ID NO: 1689 - protein, 9 aa, Homo sapiens
  Light chain CDR3 for antibody 845 (IGKV3-20)
QQYGSSLYT

SEQ ID NO: 1690 - protein, 24 aa, Homo sapiens
  Heavy chain CDR3 for antibody 845 (IGHV1-8)
ALLTVDYYDSSGSLPGRNVYGMDV

SEQ ID NO: 1691 - protein, 9 aa, Homo sapiens
  Light chain CDR3 for antibody 846 (IGKV1-27)
QKYNSAPWT

SEQ ID NO: 1692 - protein, 20 aa, Homo sapiens
  Heavy chain CDR3 for antibody 846 (IGHV1-46)
ARNLITMIVVVSRPYYGMDV

SEQ ID NO: 1693 - protein, 8 aa, Homo sapiens
  Light chain CDR3 for antibody 847 (IGKV1-33)
QQYDNLPS

SEQ ID NO: 1694 - protein, 18 aa, Homo sapiens
  Heavy chain CDR3 for antibody 847 (IGHV1-69)
ARGAGIVGAIWRHSCFNS

SEQ ID NO: 1695 - protein, 9 aa, Homo sapiens
  Light chain CDR3 for antibody 848 (IGKV1-9)
QQLNSYSYT

SEQ ID NO: 1696 - protein, 14 aa, Homo sapiens
  Heavy chain CDR3 for antibody 848 (IGHV3-72)
AGLVTSPPPYAMDV

SEQ ID NO: 1697 - protein, 9 aa, Homo sapiens
  Light chain CDR3 for antibody 849 (IGKV3-20)
QQYDASPRT

SEQ ID NO: 1698 - protein, 16 aa, Homo sapiens
  Heavy chain CDR3 for antibody 849 (IGHV4-59)
AKVERRVPFGRAAFDI

SEQ ID NO: 1699 - protein, 8 aa, Homo sapiens
  Light chain CDR3 for antibody 850 (IGKV1-9)
QQLNSYPA

SEQ ID NO: 1700 - protein, 11 aa, Homo sapiens
  Heavy chain CDR3 for antibody 850 (IGHV4-59)
ARLYGIESRDY

SEQ ID NO: 1701 - protein, 10 aa, Homo sapiens
  Light chain CDR3 for antibody 851 (IGKV3-20)
QQYGDSPPYT

SEQ ID NO: 1702 - protein, 10 aa, Homo sapiens
  Heavy chain CDR3 for antibody 851 (IGHV3-73)
ARQTDSCHDY

SEQ ID NO: 1703 - protein, 9 aa, Homo sapiens
  Light chain CDR3 for antibody 852 (IGKV1-33)
QQYDNLPLT

SEQ ID NO: 1704 - protein, 13 aa, Homo sapiens
  Heavy chain CDR3 for antibody 852 (IGHV4-31)
ARDYGGKSAQLDY

SEQ ID NO: 1705 - protein, 9 aa, Homo sapiens
  Light chain CDR3 for antibody 853 (IGKV3-20)
QQYGSSLYT

SEQ ID NO: 1706 - protein, 20 aa, Homo sapiens
  Heavy chain CDR3 for antibody 853 (IGHV4-b)
ARTGHLIRFLEWLPINWFDP

SEQ ID NO: 1707 - protein, 8 aa, Homo sapiens
  Light chain CDR3 for antibody 854 (IGKV1-33)
QQYDNLPS

SEQ ID NO: 1708 - protein, 15 aa, Homo sapiens
  Heavy chain CDR3 for antibody 854 (IGHV1-69)
ARGGDGYNLVAHYDY

SEQ ID NO: 1709 - protein, 9 aa, Homo sapiens
  Light chain CDR3 for antibody 855 (IGKV1-9)
QQLNSYPQT

SEQ ID NO: 1710 - protein, 9 aa, Homo sapiens
  Heavy chain CDR3 for antibody 855 (IGHV3-53)
ARESYGMDV

SEQ ID NO: 1711 - protein, 9 aa, Homo sapiens
  Light chain CDR3 for antibody 856 (IGKV1-39)
QQSYSTPPT

SEQ ID NO: 1712 - protein, 19 aa, Homo sapiens
  Heavy chain CDR3 for antibody 856 (IGHV1-46)
ASAHRSSSSYRLGTNWFDP

SEQ ID NO: 1713 - protein, 9 aa, Homo sapiens
  Light chain CDR3 for antibody 857 (IGKV3-20)
QQYGSSLYT

SEQ ID NO: 1714 - protein, 11 aa, Homo sapiens
  Heavy chain CDR3 for antibody 857 (IGHV1-18)
ARDGRGDLWYY

SEQ ID NO: 1715 - protein, 9 aa, Homo sapiens
  Light chain CDR3 for antibody 858 (IGKV1-33)
QQYDNLPLT

SEQ ID NO: 1716 - protein, 11 aa, Homo sapiens
  Heavy chain CDR3 for antibody 858 (IGHV3-53)
ARDGRGDRWYY

SEQ ID NO: 1717 - protein, 9 aa, Homo sapiens
  Light chain CDR3 for antibody 859 (IGKV1-9)
QQLNSYPQT

SEQ ID NO: 1718 - protein, 11 aa, Homo sapiens
  Heavy chain CDR3 for antibody 859 (IGHV3-53)
ARDLQEYGMHA

SEQ ID NO: 1719 - protein, 9 aa, Homo sapiens
  Light chain CDR3 for antibody 860 (IGKV1-33)
QQYDNLPLT

SEQ ID NO: 1720 - protein, 13 aa, Homo sapiens
  Heavy chain CDR3 for antibody 860 (IGHV4-31)
ARDDGGNSAHFGD

SEQ ID NO: 1721 - protein, 10 aa, Homo sapiens [sequence omitted]

SEQ ID NO: 1722 - protein, 16 aa, Homo sapiens
  Heavy chain CDR3 for antibody 861 (IGHV3-33)
AREGAAYGGKGGGFDY

SEQ ID NO: 1723 - protein, 9 aa, Homo sapiens
  Light chain CDR3 for antibody 862 (IGKV1-39)
QQSYSTPYT

SEQ ID NO: 1724 - protein, 24 aa, Homo sapiens
  Heavy chain CDR3 for antibody 862 (IGHV4-39)
AMMEELGRPPTTIEDSSYYYGLDV

SEQ ID NO: 1725 - protein, 8 aa, Homo sapiens
  Light chain CDR3 for antibody 863 (IGKV1-33)
QQYDNLPS

SEQ ID NO: 1726 - protein, 18 aa, Homo sapiens
  Heavy chain CDR3 for antibody 863 (IGHV1-69)
AREAGIVGAIGRHSFFDY

SEQ ID NO: 1727 - protein, 9 aa, Homo sapiens
  Light chain CDR3 for antibody 864 (IGKV1-9)
QQLTSYSYT

SEQ ID NO: 1728 - protein, 20 aa, Homo sapiens
  Heavy chain CDR3 for antibody 864 (IGHV4-39)
ARTGHLIRFLEWLPINWFDP

SEQ ID NO: 1729 - protein, 9 aa, Homo sapiens
  Light chain CDR3 for antibody 865 (IGKV1-39)
QQSYSTPPT

SEQ ID NO: 1730 - protein, 16 aa, Homo sapiens
  Heavy chain CDR3 for antibody 865 (IGHV3-23)
AKDRMTAPLHYWYFDL

SEQ ID NO: 1731 - protein, 9 aa, Homo sapiens
  Light chain CDR3 for antibody 866 (IGKV1-39)
QQSYSTPPT

SEQ ID NO: 1732 - protein, 19 aa, Homo sapiens
  Heavy chain CDR3 for antibody 866 (IGHV1-69)
AKAHRSSTSYRLEINWFGP

SEQ ID NO: 1733 - protein, 9 aa, Homo sapiens
  Light chain CDR3 for antibody 867 (IGKV3-20)
QQYGSSPLT

SEQ ID NO: 1734 - protein, 18 aa, Homo sapiens
  Heavy chain CDR3 for antibody 867 (IGHV4/OR15-8)
ARVDSAWAGTPRFWYFDL

SEQ ID NO: 1735 - protein, 9 aa, Homo sapiens
  Light chain CDR3 for antibody 868 (IGKV3-11)
QQRRNWPLT

SEQ ID NO: 1736 - protein, 20 aa, Homo sapiens
  Heavy chain CDR3 for antibody 868 (IGHV4-39)
ARTGHLIRFLEWLPINWFDP

SEQ ID NO: 1737 - protein, 9 aa, Homo sapiens
  Light chain CDR3 for antibody 869 (IGKV3-11)
QQRRNWPLT

SEQ ID NO: 1738 - protein, 16 aa, Homo sapiens
  Heavy chain CDR3 for antibody 869 (IGHV1-18)
ARANPGAVGYYYGMDV

SEQ ID NO: 1739 - protein, 9 aa, Homo sapiens
  Light chain CDR3 for antibody 870 (IGKV1-5)
QHYLGLSRT

SEQ ID NO: 1740 - protein, 20 aa, Homo sapiens
  Heavy chain CDR3 for antibody 870 (IGHV4-34)
ARTRRGMKTPTTNYYRGMDV

SEQ ID NO: 1741 - protein, 9 aa, Homo sapiens
  Light chain CDR3 for antibody 871 (IGKV1-9)
QQLTSYSYT

SEQ ID NO: 1742 - protein, 18 aa, Homo sapiens
  Heavy chain CDR3 for antibody 871 (IGHV1-69)
ARGAGIVGAIGRHSFFNY

SEQ ID NO: 1743 - protein, 11 aa, Homo sapiens
  Light chain CDR3 for antibody 872 (IGKV3-20)
QQYGRSPPSLT

SEQ ID NO: 1744 - protein, 16 aa, Homo sapiens
  Heavy chain CDR3 for antibody 872 (IGHV1-18)
ARANPGAVGYYYGMDV

SEQ ID NO: 1745 - protein, 9 aa, Homo sapiens
  Light chain CDR3 for antibody 873 (IGKV1-33)
QQYDNLPLT

SEQ ID NO: 1746 - protein, 13 aa, Homo sapiens
  Heavy chain CDR3 for antibody 873 (IGHV5-51)
ARRYSGFHAELDY

SEQ ID NO: 1747 - protein, 9 aa, Homo sapiens
  Light chain CDR3 for antibody 874 (IGKV3-11)
QQRRNWPLT

SEQ ID NO: 1748 - protein, 19 aa, Homo sapiens
  Heavy chain CDR3 for antibody 874 (IGHV1-69)
ARAHRSSTSYRLGINWFDP

SEQ ID NO: 1749 - protein, 9 aa, Homo sapiens
  Light chain CDR3 for antibody 875 (IGKV1-39)
QQSYSTPYS

SEQ ID NO: 1750 - protein, 15 aa, Homo sapiens
  Heavy chain CDR3 for antibody 875 (IGHV1-69)
ARRDIGSGWSSHFDY

SEQ ID NO: 1751 - protein, 9 aa, Homo sapiens
  Light chain CDR3 for antibody 876 (IGKV1-9)
QQLNSYPQT

SEQ ID NO: 1752 - protein, 16 aa, Homo sapiens
  Heavy chain CDR3 for antibody 876 (IGHV1-18)
ARANPGAVGYYYGMDV

SEQ ID NO: 1753 - protein, 8 aa, Homo sapiens
  Light chain CDR3 for antibody 877 (IGKV3-20)
QQYSSSLT

SEQ ID NO: 1754 - protein, 19 aa, Homo sapiens
  Heavy chain CDR3 for antibody 877 (IGHV1-69)
ARAHRSSTSYRLGINWFDP

SEQ ID NO: 1755 - protein, 9 aa, Homo sapiens
  Light chain CDR3 for antibody 878 (IGKV3-20)
QQYGSSPFT

SEQ ID NO: 1756 - protein, 7 aa, Homo sapiens
  Heavy chain CDR3 for antibody 878 (IGHV1-46)
AHPVQGY

SEQ ID NO: 1757 - protein, 7 aa, Homo sapiens
  Light chain CDR3 for antibody 879 (IGKV1-9)
QQLVEFT

SEQ ID NO: 1758 - protein, 11 aa, Homo sapiens
  Heavy chain CDR3 for antibody 879 (IGHV1-46)
AGADLLGGSNH

SEQ ID NO: 1759 - protein, 11 aa, Homo sapiens
  Light chain CDR3 for antibody 880 (IGKV3-15)
QQYNNWPPMYT

SEQ ID NO: 1760 - protein, 18 aa, Homo sapiens
  Heavy chain CDR3 for antibody 880 (IGHV1-69)
ARGAGIVGAIGRHSFFNY

SEQ ID NO: 1761 - protein, 8 aa, Homo sapiens
  Light chain CDR3 for antibody 881 (IGKV1-9)
QQYNNWPT

SEQ ID NO: 1762 - protein, 11 aa, Homo sapiens
  Heavy chain CDR3 for antibody 881 (IGHV3-53)
ARDLQVYGMDV

SEQ ID NO: 1763 - protein, 8 aa, Homo sapiens
  Light chain CDR3 for antibody 882 (IGKV1-5)
QQYNSPYI

SEQ ID NO: 1764 - protein, 9 aa, Homo sapiens
  Heavy chain CDR3 for antibody 882 (IGHV3-53)
ARESYGMDV

SEQ ID NO: 1765 - protein, 9 aa, Homo sapiens
  Light chain CDR3 for antibody 883 (IGKV1-39)
QQSYSTPPT

SEQ ID NO: 1766 - protein, 19 aa, Homo sapiens
  Heavy chain CDR3 for antibody 883 (IGHV1-69)
ARADHSSASYRLGINWFDP

SEQ ID NO: 1767 - protein, 9 aa, Homo sapiens
  Light chain CDR3 for antibody 884 (IGKV1-39)
QQSYSTPPT

SEQ ID NO: 1768 - protein, 19 aa, Homo sapiens
  Heavy chain CDR3 for antibody 884 (IGHV1-18)
ARAYSSRTSYRLGINWFDT

SEQ ID NO: 1769 - protein, 10 aa, Homo sapiens
  Light chain CDR3 for antibody 885 (IGKV3-20)
QQYGSSPPDT

SEQ ID NO: 1770 - protein, 18 aa, Homo sapiens
  Heavy chain CDR3 for antibody 885 (IGHV1-69)
ARGAGIVGAIGRHSFFNY

SEQ ID NO: 1771 - protein, 9 aa, Homo sapiens
  Light chain CDR3 for antibody 886 (IGKV1-39)
QQSYSTPPT

SEQ ID NO: 1772 - protein, 19 aa, Homo sapiens
  Heavy chain CDR3 for antibody 886 (IGHV1-18)
ARAHRSSTSYRIGIYGFDP

SEQ ID NO: 1773 - protein, 9 aa, Homo sapiens
  Light chain CDR3 for antibody 887 (IGKV1-33)
QQYDNLPLT

SEQ ID NO: 1774 - protein, 11 aa, Homo sapiens
  Heavy chain CDR3 for antibody 887 (IGHV3-53)
ARYGIGNRWSY

SEQ ID NO: 1775 - protein, 9 aa, Homo sapiens
  Light chain CDR3 for antibody 888 (IGKV1-39)
QQYDNLPLT

SEQ ID NO: 1776 - protein, 15 aa, Homo sapiens
  Heavy chain CDR3 for antibody 888 (IGHV3-64)
VKDVGWVVTVDAFDY

SEQ ID NO: 1777 - protein, 9 aa, Homo sapiens
  Light chain CDR3 for antibody 889 (IGKV3-20)
QQYGSSLYT

SEQ ID NO: 1778 - protein, 16 aa, Homo sapiens
  Heavy chain CDR3 for antibody 889 (IGHV1-18)
ARATPEAVGYYSGMDA

SEQ ID NO: 1779 - protein, 9 aa, Homo sapiens
  Light chain CDR3 for antibody 890 (IGKV1-39)
QQSYSTPPT

SEQ ID NO: 1780 - protein, 19 aa, Homo sapiens
  Heavy chain CDR3 for antibody 890 (IGHV1-69)
ARAYRSSTSYRLGINWLDA

SEQ ID NO: 1781 - protein, 9 aa, Homo sapiens
  Light chain CDR3 for antibody 891 (IGKV3-20)
QQYGSSLYT

SEQ ID NO: 1782 - protein, 16 aa, Homo sapiens
  Heavy chain CDR3 for antibody 891 (IGHV1-18)
ASANPGAVGYSYGMDD

SEQ ID NO: 1783 - protein, 9 aa, Homo sapiens
  Light chain CDR3 for antibody 892 (IGKV1-33)
QQYDNLPLT

SEQ ID NO: 1784 - protein, 11 aa, Homo sapiens
  Heavy chain CDR3 for antibody 892 (IGHV3-53)
ARDGRGYPLSY

SEQ ID NO: 1785 - protein, 11 aa, Homo sapiens
  Light chain CDR3 for antibody 893 (IGKV1-39)
QQSYSNPPEDS

SEQ ID NO: 1786 - protein, 22 aa, Homo sapiens
  Heavy chain CDR3 for antibody 893 (IGHV3-66)
ARAHQKRIAAAGTNYYYYYMDV

SEQ ID NO: 1787 - protein, 9 aa, Homo sapiens
  Light chain CDR3 for antibody 894 (IGKV1-39)
QQSYSTPPT

SEQ ID NO: 1788 - protein, 15 aa, Homo sapiens
  Heavy chain CDR3 for antibody 894 (IGHV3-53)
LRGGHHSGLGSPWGY

SEQ ID NO: 1789 - protein, 9 aa, Homo sapiens
  Light chain CDR3 for antibody 895 (IGKV1-39)
QQSYSTPPT

SEQ ID NO: 1790 - protein, 14 aa, Homo sapiens
  Heavy chain CDR3 for antibody 895 (IGHV3-23)
AKALAAAGYDAFDI

SEQ ID NO: 1791 - protein, 9 aa, Homo sapiens
  Light chain CDR3 for antibody 896 (IGKV1-9)
QQLNSYPQT

SEQ ID NO: 1792 - protein, 11 aa, Homo sapiens
  Heavy chain CDR3 for antibody 896 (IGHV3-53)
ARDLHYYGIDF

SEQ ID NO: 1793 - protein, 9 aa, Homo sapiens
  Light chain CDR3 for antibody 897 (IGKV1-33)
QQYDNLPLT

SEQ ID NO: 1794 - protein, 13 aa, Homo sapiens
  Heavy chain CDR3 for antibody 897 (IGHV4-31)
ASDYCGNSSQFGY

SEQ ID NO: 1795 - protein, 9 aa, Homo sapiens
  Light chain CDR3 for antibody 898 (IGKV1-33)
QQYDNLPLT

SEQ ID NO: 1796 - protein, 11 aa, Homo sapiens
  Heavy chain CDR3 for antibody 898 (IGHV3-53)
ARDGRDDPWYY

SEQ ID NO: 1797 - protein, 11 aa, Homo sapiens
  Light chain CDR3 for antibody 899 (IGKV3-20)
QQYDASPPTWT

SEQ ID NO: 1798 - protein, 17 aa, Homo sapiens
  Heavy chain CDR3 for antibody 899 (IGHV4/OR15-8)
ARGKGWFGSHFSYYMDV

SEQ ID NO: 1799 - protein, 9 aa, Homo sapiens
  Light chain CDR3 for antibody 900 (IGKV1-39)
QQSYSTPYT

SEQ ID NO: 1800 - protein, 19 aa, Homo sapiens
  Heavy chain CDR3 for antibody 900 (IGHV1-69)
AWTFDYGDYEVAYYYGMDV

SEQ ID NO: 1801 - protein, 9 aa, Homo sapiens
  Light chain CDR3 for antibody 901 (IGKV1-9)
QQLNSYPQT

SEQ ID NO: 1802 - protein, 11 aa, Homo sapiens
  Heavy chain CDR3 for antibody 901 (IGHV3-53)
ARDLQEYCMHV

SEQ ID NO: 1803 - protein, 9 aa, Homo sapiens
  Light chain CDR3 for antibody 902 (IGKV3-20)
QQYGSSPYT

SEQ ID NO: 1804 - protein, 16 aa, Homo sapiens
  Heavy chain CDR3 for antibody 902 (IGHV1-18)
ARTWIQLYYYYYYMDV

SEQ ID NO: 1805 - protein, 9 aa, Homo sapiens
  Light chain CDR3 for antibody 903 (IGKV1-9)
QQLNSYPPP

SEQ ID NO: 1806 - protein, 20 aa, Homo sapiens
  Heavy chain CDR3 for antibody 903 (IGHV4-30-2)
ARTGHLIRFLEWLPINWFDA

SEQ ID NO: 1807 - protein, 9 aa, Homo sapiens
  Light chain CDR3 for antibody 904 (IGKV1-39)
QQSYSTPPT

SEQ ID NO: 1808 - protein, 19 aa, Homo sapiens
  Heavy chain CDR3 for antibody 904 (IGHV1-69)
ARAYRSSASSRLGINWFDP

SEQ ID NO: 1809 - protein, 9 aa, Homo sapiens
  Light chain CDR3 for antibody 905 (IGKV1-9)
QQLTSYSYT

SEQ ID NO: 1810 - protein, 13 aa, Homo sapiens
  Heavy chain CDR3 for antibody 905 (IGHV4-31)
ARDYGGNSAQFGY

SEQ ID NO: 1811 - protein, 9 aa, Homo sapiens
  Light chain CDR3 for antibody 906 (IGKV1-12)
QQADSFPWP

SEQ ID NO: 1812 - protein, 16 aa, Homo sapiens
  Heavy chain CDR3 for antibody 906 (IGHV3-23)
AKDRMTAPLHYWYFDL

SEQ ID NO: 1813 - protein, 9 aa, Homo sapiens
  Light chain CDR3 for antibody 907 (IGKV1-39)
QQSYSTPPT

SEQ ID NO: 1814 - protein, 19 aa, Homo sapiens
  Heavy chain CDR3 for antibody 907 (IGHV1-69)
ARAHRSSAGYRLGINWFDP

SEQ ID NO: 1815 - protein, 9 aa, Homo sapiens
  Light chain CDR3 for antibody 908 (IGKV1-9)
QQLNSYPQT

SEQ ID NO: 1816 - protein, 16 aa, Homo sapiens
  Heavy chain CDR3 for antibody 908 (IGHV1-18)
ARANHGAVGYYYGMDV

SEQ ID NO: 1817 - protein, 9 aa, Homo sapiens
  Light chain CDR3 for antibody 909 (IGKV3-20)
QQYGSSLYT

SEQ ID NO: 1818 - protein, 14 aa, Homo sapiens
  Heavy chain CDR3 for antibody 909 (IGHV3-23)
AKALAAAGYDAFDI

SEQ ID NO: 1819 - protein, 8 aa, Homo sapiens
  Light chain CDR3 for antibody 910 (IGKV1-33)
QQYDNLPS

SEQ ID NO: 1820 - protein, 13 aa, Homo sapiens
  Heavy chain CDR3 for antibody 910 (IGHV1-69)
ARFPNAALRAFDI

SEQ ID NO: 1821 - protein, 9 aa, Homo sapiens
  Light chain CDR3 for antibody 911 (IGKV1-9)
QQLNSYPPP

SEQ ID NO: 1822 - protein, 11 aa, Homo sapiens
  Heavy chain CDR3 for antibody 911 (IGHV3-53)
ARDRGRYGMDV

SEQ ID NO: 1823 - protein, 9 aa, Homo sapiens
  Light chain CDR3 for antibody 912 (IGKV3-11)
QQRRNWPLT

SEQ ID NO: 1824 - protein, 13 aa, Homo sapiens
  Heavy chain CDR3 for antibody 912 (IGHV4-31)
ARDYGGNSAQFGY

SEQ ID NO: 1825 - protein, 9 aa, Homo sapiens
  Light chain CDR3 for antibody 913 (IGKV1-33)
QQYDNLPLT

SEQ ID NO: 1826 - protein, 13 aa, Homo sapiens
  Heavy chain CDR3 for antibody 913 (IGHV4-31)
ARDYGGNSDQFGS

SEQ ID NO: 1827 - protein, 9 aa, Homo sapiens
  Light chain CDR3 for antibody 914 (IGKV1-39)
QQSYSTPPT

SEQ ID NO: 1828 - protein, 13 aa, Homo sapiens
  Heavy chain CDR3 for antibody 914 (IGHV1-69)
ARFPNAALRAFDI

SEQ ID NO: 1829 - protein, 10 aa, Homo sapiens
  Light chain CDR3 for antibody 915 (IGKV3-NL1)
QQYGSSPPDT

SEQ ID NO: 1830 - protein, 11 aa, Homo sapiens
  Heavy chain CDR3 for antibody 915 (IGHV3-53)
ARDLQVYGMDV

SEQ ID NO: 1831 - protein, 7 aa, Homo sapiens
  Light chain CDR3 for antibody 916 (IGKV1-9)
QQLKGAT

SEQ ID NO: 1832 - protein, 14 aa, Homo sapiens
  Heavy chain CDR3 for antibody 916 (IGHV1-8)
ASDRRWLQLGAFDI

SEQ ID NO: 1833 - protein, 11 aa, Homo sapiens
  Light chain CDR3 for antibody 917 (IGKV3-15)
QQHNNWPPMYT

SEQ ID NO: 1834 - protein, 11 aa, Homo sapiens
  Heavy chain CDR3 for antibody 917 (IGHV3-53)
ARDRGPYGMDV

SEQ ID NO: 1835 - protein, 9 aa, Homo sapiens
  Light chain CDR3 for antibody 918 (IGKV1-9)
QQLNSYPQT

SEQ ID NO: 1836 - protein, 11 aa, Homo sapiens
  Heavy chain CDR3 for antibody 918 (IGHV3-53)
ARELQVYGIDV

SEQ ID NO: 1837 - protein, 9 aa, Homo sapiens
  Light chain CDR3 for antibody 919 (IGKV1-39)
QQSYSTPPT

SEQ ID NO: 1838 - protein, 19 aa, Homo sapiens
  Heavy chain CDR3 for antibody 919 (IGHV1-8)
ARAHLSSTSYRLRINWFDA

SEQ ID NO: 1839 - protein, 8 aa, Homo sapiens
  Light chain CDR3 for antibody 920 (IGKV3-11)
QQRTNWPT

SEQ ID NO: 1840 - protein, 20 aa, Homo sapiens
  Heavy chain CDR3 for antibody 920 (IGHV1-18)
ARAGDSERYYYEGYSYYMDV

SEQ ID NO: 1841 - protein, 9 aa, Homo sapiens
  Light chain CDR3 for antibody 921 (IGKV1-33)
QQYDNLPLT

SEQ ID NO: 1842 - protein, 13 aa, Homo sapiens
  Heavy chain CDR3 for antibody 921 (IGHV4-30-2)
AREYGGNSDQFGD

SEQ ID NO: 1843 - protein, 9 aa, Homo sapiens
  Light chain CDR3 for antibody 922 (IGKV1-9)
QQLNSYPQT

SEQ ID NO: 1844 - protein, 19 aa, Homo sapiens
  Heavy chain CDR3 for antibody 922 (IGHV4/OR15-8)
ARDALGYCSGGRCYAAFDI

SEQ ID NO: 1845 - protein, 9 aa, Homo sapiens
  Light chain CDR3 for antibody 923 (IGKV1-39)
QQSYSTPLT

SEQ ID NO: 1846 - protein, 24 aa, Homo sapiens
  Heavy chain CDR3 for antibody 923 (IGHV1-8)
ALLTVDYYDSSGSIPGRNVYGMDG

SEQ ID NO: 1847 - protein, 9 aa, Homo sapiens
  Light chain CDR3 for antibody 924 (IGKV1-9)
QQLNSYPQT

SEQ ID NO: 1848 - protein, 16 aa, Homo sapiens
  Heavy chain CDR3 for antibody 924 (IGHV1-18)
ARTWIQLYYYYYYMDV

SEQ ID NO: 1849 - protein, 9 aa, Homo sapiens
  Light chain CDR3 for antibody 925 (IGKV1-9)
QQLNSYPPP

SEQ ID NO: 1850 - protein, 11 aa, Homo sapiens
  Heavy chain CDR3 for antibody 925 (IGHV3-53)
ARDLQVYGIDV

SEQ ID NO: 1851 - protein, 9 aa, Homo sapiens
  Light chain CDR3 for antibody 926 (IGKV1-39)
QQSYSTPPT

SEQ ID NO: 1852 - protein, 19 aa, Homo sapiens
  Heavy chain CDR3 for antibody 926 (IGHV1-69)
ARAQRSGTSYRLGINCFDP

SEQ ID NO: 1853 - protein, 9 aa, Homo sapiens
  Light chain CDR3 for antibody 927 (IGKV1-33)
QQYDNLPLT

SEQ ID NO: 1854 - protein, 13 aa, Homo sapiens
  Heavy chain CDR3 for antibody 927 (IGHV4-31)
ARDCGDKSEQFGY

SEQ ID NO: 1855 - protein, 9 aa, Homo sapiens
  Light chain CDR3 for antibody 928 (IGKV1-9)
QQSLTIPYT

SEQ ID NO: 1856 - protein, 11 aa, Homo sapiens
  Heavy chain CDR3 for antibody 928 (IGHV3-53)
ARDLQPYGMDV

SEQ ID NO: 1857 - protein, 9 aa, Homo sapiens
  Light chain CDR3 for antibody 929 (IGKV1-9)
QQLTSYSYT

SEQ ID NO: 1858 - protein, 15 aa, Homo sapiens
  Heavy chain CDR3 for antibody 929 (IGHV3-64)
VKDVGWVVTVDAFDY

SEQ ID NO: 1859 - protein, 9 aa, Homo sapiens
  Light chain CDR3 for antibody 930 (IGKV1-33)
QQYDNLPLT

SEQ ID NO: 1860 - protein, 11 aa, Homo sapiens
  Heavy chain CDR3 for antibody 930 (IGHV3-53)
ARDGRGDRLHY

SEQ ID NO: 1861 - protein, 8 aa, Homo sapiens
  Light chain CDR3 for antibody 931 (IGKV3-15)
QQYIKLLS

SEQ ID NO: 1862 - protein, 9 aa, Homo sapiens
  Heavy chain CDR3 for antibody 931 (IGHV3-53)
ARESYGMDV

SEQ ID NO: 1863 - protein, 11 aa, Homo sapiens
  Light chain CDR3 for antibody 932 (IGKV3-15)
QQYNNWPPMYT

SEQ ID NO: 1864 - protein, 12 aa, Homo sapiens
  Heavy chain CDR3 for antibody 932 (IGHV3-66)
TRDLRSVLATDY

SEQ ID NO: 1865 - protein, 10 aa, Homo sapiens
  Light chain CDR3 for antibody 933 (IGKV3-20)
QQYGSSPPDT

SEQ ID NO: 1866 - protein, 9 aa, Homo sapiens
  Heavy chain CDR3 for antibody 933 (IGHV3-53)
ARESYGMDV

SEQ ID NO: 1867 - protein, 9 aa, Homo sapiens
  Light chain CDR3 for antibody 934 (IGKV1-33)
QQYDNLPLT

SEQ ID NO: 1868 - protein, 16 aa, Homo sapiens
  Heavy chain CDR3 for antibody 934 (IGHV3-23)
AKDRMTAPLHYWYFDL

SEQ ID NO: 1869 - protein, 9 aa, Homo sapiens
  Light chain CDR3 for antibody 935 (IGKV1-33)
QQCHSLPAT

SEQ ID NO: 1870 - protein, 14 aa, Homo sapiens
  Heavy chain CDR3 for antibody 935 (IGHV4-39)
ARKEVYSESSGYYG

SEQ ID NO: 1871 - protein, 9 aa, Homo sapiens
  Light chain CDR3 for antibody 936 (IGKV1-39)
QQSYSTPPT

SEQ ID NO: 1872 - protein, 15 aa, Homo sapiens
  Heavy chain CDR3 for antibody 936 (IGHV1-69)
ARGGDGYNLVAHYDY

SEQ ID NO: 1873 - protein, 8 aa, Homo sapiens
  Light chain CDR3 for antibody 937 (IGKV1-5)
QQYAFYWT

SEQ ID NO: 1874 - protein, 9 aa, Homo sapiens
  Heavy chain CDR3 for antibody 937 (IGHV4-61)
ANRFGSPFY

SEQ ID NO: 1875 - protein, 9 aa, Homo sapiens
  Light chain CDR3 for antibody 938 (IGKV1-39)
QQSYSTPPT

SEQ ID NO: 1876 - protein, 15 aa, Homo sapiens
  Heavy chain CDR3 for antibody 938 (IGHV3-74)
ARDLGTMIVEENFDY

SEQ ID NO: 1877 - protein, 9 aa, Homo sapiens
  Light chain CDR3 for antibody 939 (IGKV1-39)
QQSYSTPPT

SEQ ID NO: 1878 - protein, 19 aa, Homo sapiens
  Heavy chain CDR3 for antibody 939 (IGHV1-69)
ARAHHSSTSYQLGINCFDP

SEQ ID NO: 1879 - protein, 9 aa, Homo sapiens
  Light chain CDR3 for antibody 940 (IGKV3-20)
QQYGSSPLT

SEQ ID NO: 1880 - protein, 19 aa, Homo sapiens
  Heavy chain CDR3 for antibody 940 (IGHV1-69)
ARAHSSITSYRLGINWFDP

SEQ ID NO: 1881 - protein, 9 aa, Homo sapiens
  Light chain CDR3 for antibody 941 (IGKV1-33)
QQYDNLPLT

SEQ ID NO: 1882 - protein, 13 aa, Homo sapiens
  Heavy chain CDR3 for antibody 941 (IGHV4-31)
ARGYGGNSGQFGY

SEQ ID NO: 1883 - protein, 11 aa, Homo sapiens
  Light chain CDR3 for antibody 942 (IGKV3-15)
QQYNNWPPMYT

SEQ ID NO: 1884 - protein, 13 aa, Homo sapiens
  Heavy chain CDR3 for antibody 942 (IGHV5-51)
ARRYSGFHAELDY

SEQ ID NO: 1885 - protein, 11 aa, Homo sapiens
  Light chain CDR3 for antibody 943 (IGKV3-20)
QQYGRSPPSLP

SEQ ID NO: 1886 - protein, 19 aa, Homo sapiens
  Heavy chain CDR3 for antibody 943 (IGHV1-69)
ARTSRSATIFGVLYDGLDI

SEQ ID NO: 1887 - protein, 8 aa, Homo sapiens
  Light chain CDR3 for antibody 944 (IGKV1-33)
QYGNLPLT

SEQ ID NO: 1888 - protein, 13 aa, Homo sapiens
  Heavy chain CDR3 for antibody 944 (IGHV4-31)
ARDYGGNSAQFGY

SEQ ID NO: 1889 - protein, 9 aa, Homo sapiens
  Light chain CDR3 for antibody 945 (IGKV1-9)
QQLTSYSYT

SEQ ID NO: 1890 - protein, 9 aa, Homo sapiens
  Heavy chain CDR3 for antibody 945 (IGHV3-53)
ARESYGIDV

SEQ ID NO: 1891 - protein, 9 aa, Homo sapiens
  Light chain CDR3 for antibody 946 (IGKV3-20)
QQYGSSPLT

SEQ ID NO: 1892 - protein, 14 aa, Homo sapiens
  Heavy chain CDR3 for antibody 946 (IGHV4-30-2)
ARWSSNHFGALFDS

SEQ ID NO: 1893 - protein, 9 aa, Homo sapiens
  Light chain CDR3 for antibody 947 (IGKV1-39)
QQSYSTPPT

SEQ ID NO: 1894 - protein, 19 aa, Homo sapiens
  Heavy chain CDR3 for antibody 947 (IGHV1-69)
ARADSSSTSCRLGINWFDP

SEQ ID NO: 1895 - protein, 8 aa, Homo sapiens
  Light chain CDR3 for antibody 948 (IGKV1-33)
QQYDNLPS

SEQ ID NO: 1896 - protein, 18 aa, Homo sapiens
  Heavy chain CDR3 for antibody 948 (IGHV1-69)
ARGAGIVGAIGRHAVFNY

SEQ ID NO: 1897 - protein, 9 aa, Homo sapiens
  Light chain CDR3 for antibody 949 (IGKV2D-28)
MQALQTSFT

SEQ ID NO: 1898 - protein, 16 aa, Homo sapiens
  Heavy chain CDR3 for antibody 949 (IGHV5-51)
ARLQPPPYYYYYGMDV

SEQ ID NO: 1899 - protein, 8 aa, Homo sapiens
  Light chain CDR3 for antibody 950 (IGKV3-20)
QQYGSSPT

SEQ ID NO: 1900 - protein, 20 aa, Homo sapiens
  Heavy chain CDR3 for antibody 950 (IGHV1-2)
ASGTYYYDSSGYYWNDAFDI

SEQ ID NO: 1901 - protein, 9 aa, Homo sapiens
  Light chain CDR3 for antibody 951 (IGKV1-33)
QQYDNLPPT

SEQ ID NO: 1902 - protein, 20 aa, Homo sapiens
  Heavy chain CDR3 for antibody 951 (IGHV3-64)
AKTAGPYCSGGSCYSGNVDY

SEQ ID NO: 1903 - protein, 10 aa, Homo sapiens
  Light chain CDR3 for antibody 952 (IGKV1-39)
QQSYITPLYS

SEQ ID NO: 1904 - protein, 16 aa, Homo sapiens
  Heavy chain CDR3 for antibody 952 (IGHV3-13)
ARVTYDSSGYLHWFDP

SEQ ID NO: 1905 - protein, 10 aa, Homo sapiens
  Light chain CDR3 for antibody 953 (IGKV1-9)
QQLNSYPPLT

SEQ ID NO: 1906 - protein, 18 aa, Homo sapiens
  Heavy chain CDR3 for antibody 953 (IGHV3-33)
AKDGAAMARGYYYYGMDV

SEQ ID NO: 1907 - protein, 9 aa, Homo sapiens
  Light chain CDR3 for antibody 954 (IGKV3-20)
QQYGSSPPT

SEQ ID NO: 1908 - protein, 24 aa, Homo sapiens
  Heavy chain CDR3 for antibody 954 (IGHV1-46)
AGPITMVRGVIIPDYYYYYYGMDV

SEQ ID NO: 1909 - protein, 10 aa, Homo sapiens
  Light chain CDR3 for antibody 955 (IGKV1-39)
QQSYNSPPYT

SEQ ID NO: 1910 - protein, 18 aa, Homo sapiens
  Heavy chain CDR3 for antibody 955 (IGHV2-5)
ARSQARDSSWPTRNYFDY

SEQ ID NO: 1911 - protein, 10 aa, Homo sapiens
  Light chain CDR3 for antibody 956 (IGKV3-11)
QQRSNWPSIT

SEQ ID NO: 1912 - protein, 14 aa, Homo sapiens
  Heavy chain CDR3 for antibody 956 (IGHV1-8)
ASVPYGSGRRYFDY

SEQ ID NO: 1913 - protein, 8 aa, Homo sapiens
  Light chain CDR3 for antibody 957 (IGKV3-20)
QQYGSSPT

SEQ ID NO: 1914 - protein, 9 aa, Homo sapiens
  Heavy chain CDR3 for antibody 957 (IGHV4/OR15-8)
ARVLGAMFT

SEQ ID NO: 1915 - protein, 8 aa, Homo sapiens
  Light chain CDR3 for antibody 958 (IGKV1-33)
QQYDTPST

SEQ ID NO: 1916 - protein, 12 aa, Homo sapiens
  Heavy chain CDR3 for antibody 958 (IGHV4-b)
ARRDPVREGFDI

SEQ ID NO: 1917 - protein, 10 aa, Homo sapiens
  Light chain CDR3 for antibody 959 (IGKV1-39)
QQSYSTPLCS

SEQ ID NO: 1918 - protein, 15 aa, Homo sapiens
  Heavy chain CDR3 for antibody 959 (IGHV3-9)
AKVDWSGYYGDAFDI

SEQ ID NO: 1919 - protein, 9 aa, Homo sapiens
  Light chain CDR3 for antibody 960 (IGKV1-27)
QKYNTAPWT

SEQ ID NO: 1920 - protein, 16 aa, Homo sapiens
  Heavy chain CDR3 for antibody 960 (IGHV1-18)
ARYLFGFGEVLTPFDY

SEQ ID NO: 1921 - protein, 9 aa, Homo sapiens
  Light chain CDR3 for antibody 961 (IGKV1-39)
QQSYSTPLT

SEQ ID NO: 1922 - protein, 12 aa, Homo sapiens
  Heavy chain CDR3 for antibody 961 (IGHV3-64)
AQSPVTTGFFDD

SEQ ID NO: 1923 - protein, 9 aa, Homo sapiens
  Light chain CDR3 for antibody 962 (IGKV3-20)
QQYGSSPRT

SEQ ID NO: 1924 - protein, 9 aa, Homo sapiens
  Heavy chain CDR3 for antibody 962 (IGHV1-18)
ARGSQLGDY

SEQ ID NO: 1925 - protein, 10 aa, Homo sapiens
  Light chain CDR3 for antibody 963 (IGKV3-15)
QQYGDWPLIT

SEQ ID NO: 1926 - protein, 16 aa, Homo sapiens
  Heavy chain CDR3 for antibody 963 (IGHV3-30)
AKDGEYRNGWYEPVDY

SEQ ID NO: 1927 - protein, 9 aa, Homo sapiens
  Light chain CDR3 for antibody 964 (IGKV3-20)
QQYGSSPPT

SEQ ID NO: 1928 - protein, 12 aa, Homo sapiens
  Heavy chain CDR3 for antibody 964 (IGHV1-69)
ARWGDYYDSSDY

SEQ ID NO: 1929 - protein, 8 aa, Homo sapiens
  Light chain CDR3 for antibody 965 (IGKV3-11)
QQRTNWPT

SEQ ID NO: 1930 - protein, 20 aa, Homo sapiens
  Heavy chain CDR3 for antibody 965 (IGHV1-18)
ARAGDSERYYYEGYNYYMDV

SEQ ID NO: 1931 - protein, 8 aa, Homo sapiens
  Light chain CDR3 for antibody 966 (IGKV2D-28)
MQALQTIT

SEQ ID NO: 1932 - protein, 20 aa, Homo sapiens
  Heavy chain CDR3 for antibody 966 (IGHV2-26)
AHISYDFWSAYRDAENWFDP

SEQ ID NO: 1933 - protein, 10 aa, Homo sapiens
  Light chain CDR3 for antibody 967 (IGKV1-39)
QQSYSTPALT

SEQ ID NO: 1934 - protein, 9 aa, Homo sapiens
  Heavy chain CDR3 for antibody 967 (IGHV4/OR15-8)
ARVLGAMFT

SEQ ID NO: 1935 - protein, 9 aa, Homo sapiens
  Light chain CDR3 for antibody 968 (IGKV1-5)
QQYNQYSET

SEQ ID NO: 1936 - protein, 9 aa, Homo sapiens
  Heavy chain CDR3 for antibody 968 (IGHV3-53)
ARNPSSGGY

SEQ ID NO: 1937 - protein, 8 aa, Homo sapiens
  Light chain CDR3 for antibody 969 (IGKV3-20)
QQYGSSPT

SEQ ID NO: 1938 - protein, 20 aa, Homo sapiens
  Heavy chain CDR3 for antibody 969 (IGHV5-51)
ARLGVEQQLPPHPNYYGMDV

SEQ ID NO: 1939 - protein, 9 aa, Homo sapiens
  Light chain CDR3 for antibody 970 (IGKV1-39)
QQSHSPPLT

SEQ ID NO: 1940 - protein, 15 aa, Homo sapiens
  Heavy chain CDR3 for antibody 970 (IGHV1-2)
ARAVSAQRLIIISDF

SEQ ID NO: 1941 - protein, 10 aa, Homo sapiens
  Light chain CDR3 for antibody 971 (IGKV3-15)
QQYYNWPPWT

SEQ ID NO: 1942 - protein, 11 aa, Homo sapiens
  Heavy chain CDR3 for antibody 971 (IGHV1-8)
ARGLGGHYFDY

SEQ ID NO: 1943 - protein, 9 aa, Homo sapiens
  Light chain CDR3 for antibody 972 (IGKV1-39)
QQSYSIPWT

SEQ ID NO: 1944 - protein, 10 aa, Homo sapiens
  Heavy chain CDR3 for antibody 972 (IGHV6-1)
ARTENRRFDP

SEQ ID NO: 1945 - protein, 10 aa, Homo sapiens
  Light chain CDR3 for antibody 973 (IGKV1-39)
QQSYSTPPWT

SEQ ID NO: 1946 - protein, 20 aa, Homo sapiens
  Heavy chain CDR3 for antibody 973 (IGHV5-51)
ARLGVEQQLPPHPNYYGMDV

SEQ ID NO: 1947 - protein, 8 aa, Homo sapiens
  Light chain CDR3 for antibody 974 (IGKV1-5)
QQYDHYPT

SEQ ID NO: 1948 - protein, 17 aa, Homo sapiens
  Heavy chain CDR3 for antibody 974 (IGHV3-23)
AKSHYCSGGRCYSVFDS

SEQ ID NO: 1949 - protein, 9 aa, Homo sapiens
  Light chain CDR3 for antibody 975 (IGKV3-20)
QQYGRSPRT

SEQ ID NO: 1950 - protein, 15 aa, Homo sapiens
  Heavy chain CDR3 for antibody 975 (IGHV1-18)
ARPITILDYYYGMDV

SEQ ID NO: 1951 - protein, 9 aa, Homo sapiens
  Light chain CDR3 for antibody 976 (IGKV3-11)
QQYNDWPWT

SEQ ID NO: 1952 - protein, 10 aa, Homo sapiens
  Heavy chain CDR3 for antibody 976 (IGHV2-5)
AHQRTADIDY

SEQ ID NO: 1953 - protein, 8 aa, Homo sapiens
  Light chain CDR3 for antibody 977 (IGKV3-20)
QQYGSSPT

SEQ ID NO: 1954 - protein, 13 aa, Homo sapiens
  Heavy chain CDR3 for antibody 977 (IGHV4-b)
ARSPRGDFYYFDY

SEQ ID NO: 1955 - protein, 9 aa, Homo sapiens
  Light chain CDR3 for antibody 978 (IGKV3-20)
QQYGTSART

SEQ ID NO: 1956 - protein, 12 aa, Homo sapiens
  Heavy chain CDR3 for antibody 978 (IGHV4-34)
ARGYRGYKFWDH

SEQ ID NO: 1957 - protein, 8 aa, Homo sapiens
  Light chain CDR3 for antibody 979 (IGKV1-NL1)
QQYYSTRT

SEQ ID NO: 1958 - protein, 14 aa, Homo sapiens
  Heavy chain CDR3 for antibody 979 (IGHV3-20)
ARQDDYEPLLGLDS

SEQ ID NO: 1959 - protein, 8 aa, Homo sapiens
  Light chain CDR3 for antibody 980 (IGKV1-9)
QQVYMYFS

SEQ ID NO: 1960 - protein, 19 aa, Homo sapiens
  Heavy chain CDR3 for antibody 980 (IGHV4-b)
ARNASRVYDHVTAYSPFDY

SEQ ID NO: 1961 - protein, 9 aa, Homo sapiens
  Light chain CDR3 for antibody 981 (IGKV1-16)
QQYISYPIT

SEQ ID NO: 1962 - protein, 14 aa, Homo sapiens
  Heavy chain CDR3 for antibody 981 (IGHV4-b)
ARRIGVAGHWYFDL

SEQ ID NO: 1963 - protein, 10 aa, Homo sapiens
  Light chain CDR3 for antibody 982 (IGKV1-39)
QQSYSTPPWT

SEQ ID NO: 1964 - protein, 20 aa, Homo sapiens
  Heavy chain CDR3 for antibody 982 (IGHV1-2)
ASGTYYYDSSGYYWNDAFDI

SEQ ID NO: 1965 - protein, 9 aa, Homo sapiens
  Light chain CDR3 for antibody 983 (IGKV1-27)
QKYNSPPLT

SEQ ID NO: 1966 - protein, 19 aa, Homo sapiens
  Heavy chain CDR3 for antibody 983 (IGHV1-69)
ARDIVAVPAAEWGLYGMDV

SEQ ID NO: 1967 - protein, 9 aa, Homo sapiens
  Light chain CDR3 for antibody 984 (IGKV1-17)
LQHHNYPWT

SEQ ID NO: 1968 - protein, 15 aa, Homo sapiens
  Heavy chain CDR3 for antibody 984 (IGHV1-69)
AVNDAYTNSWYYFDY

SEQ ID NO: 1969 - protein, 8 aa, Homo sapiens
  Light chain CDR3 for antibody 985 (IGKV3-20)
QQYGSSPT

SEQ ID NO: 1970 - protein, 21 aa, Homo sapiens
  Heavy chain CDR3 for antibody 985 (IGHV4/OR15-8)
ARDRGRYYDSSGYEEMYAFDI

SEQ ID NO: 1971 - protein, 8 aa, Homo sapiens
  Light chain CDR3 for antibody 986 (IGKV3-20)
QQYGSSPT

SEQ ID NO: 1972 - protein, 16 aa, Homo sapiens
  Heavy chain CDR3 for antibody 986 (IGHV4-61)
ARDGSYSSSWKNWFDP

SEQ ID NO: 1973 - protein, 9 aa, Homo sapiens
  Light chain CDR3 for antibody 987 (IGKV1-39)
QQTYSTPMT

SEQ ID NO: 1974 - protein, 11 aa, Homo sapiens
  Heavy chain CDR3 for antibody 987 (IGHV1-8)
AVAGHRRSLSL

SEQ ID NO: 1975 - protein, 9 aa, Homo sapiens
  Light chain CDR3 for antibody 988 (IGKV3-20)
QQYGTSPQT

SEQ ID NO: 1976 - protein, 17 aa, Homo sapiens
  Heavy chain CDR3 for antibody 988 (IGHV1-69)
ARGTFSGYSPTLHWFDP

SEQ ID NO: 1977 - protein, 9 aa, Homo sapiens
  Light chain CDR3 for antibody 989 (IGKV1-33)
QQYDNLPYS

SEQ ID NO: 1978 - protein, 13 aa, Homo sapiens
  Heavy chain CDR3 for antibody 989 (IGHV4-b)
ARSPRGDFYYFDY

SEQ ID NO: 1979 - protein, 10 aa, Homo sapiens
  Light chain CDR3 for antibody 990 (IGKV3-15)
QQYNNWPPYT

SEQ ID NO: 1980 - protein, 16 aa, Homo sapiens
  Heavy chain CDR3 for antibody 990 (IGHV2-26)
ARIRPEWLRFYWYFDL

SEQ ID NO: 1981 - protein, 9 aa, Homo sapiens
  Light chain CDR3 for antibody 991 (IGKV2-30)
MQGAHWPYT

SEQ ID NO: 1982 - protein, 11 aa, Homo sapiens
  Heavy chain CDR3 for antibody 991 (IGHV4-59)
ARASYGNHFDY

SEQ ID NO: 1983 - protein, 10 aa, Homo sapiens
  Light chain CDR3 for antibody 992 (IGKV1-39)
QQSYSTPPWT

SEQ ID NO: 1984 - protein, 24 aa, Homo sapiens
  Heavy chain CDR3 for antibody 992 (IGHV1-46)
AGPITMVRGVIIPDYYYYYYGMDV

SEQ ID NO: 1985 - protein, 8 aa, Homo sapiens
  Light chain CDR3 for antibody 993 (IGKV3-20)
QQYGSSPT

SEQ ID NO: 1986 - protein, 18 aa, Homo sapiens
  Heavy chain CDR3 for antibody 993 (IGHV3-13)
ARGVSSSWGYYYYYYMDV

SEQ ID NO: 1987 - protein, 10 aa, Homo sapiens
  Light chain CDR3 for antibody 994 (IGKV3-15)
QQYDNWPPYT

SEQ ID NO: 1988 - protein, 17 aa, Homo sapiens
  Heavy chain CDR3 for antibody 994 (IGHV4-34)
ARGQGMGVAALFFYFDS

SEQ ID NO: 1989 - protein, 10 aa, Homo sapiens
  Light chain CDR3 for antibody 995 (IGKV3-11)
QQRSNWPPFT

SEQ ID NO: 1990 - protein, 15 aa, Homo sapiens
  Heavy chain CDR3 for antibody 995 (IGHV1-69)
ARYTGDGYNRGDFDY

SEQ ID NO: 1991 - protein, 9 aa, Homo sapiens
  Light chain CDR3 for antibody 996 (IGKV3-20)
QQYGSLPRT

SEQ ID NO: 1992 - protein, 12 aa, Homo sapiens
  Heavy chain CDR3 for antibody 996 (IGHV3-74)
ARGGWHGSYFDY

SEQ ID NO: 1993 - protein, 9 aa, Homo sapiens
  Light chain CDR3 for antibody 997 (IGKV1-39)
QQSYSTPYT

SEQ ID NO: 1994 - protein, 17 aa, Homo sapiens
  Heavy chain CDR3 for antibody 997 (IGHV1-2)
ARDDCSGGSCYSSWFDP

SEQ ID NO: 1995 - protein, 9 aa, Homo sapiens
  Light chain CDR3 for antibody 998 (IGKV1-12)
QQANSFPYS

SEQ ID NO: 1996 - protein, 13 aa, Homo sapiens
  Heavy chain CDR3 for antibody 998 (IGHV4-b)
ARSPRGDFYYFDY

SEQ ID NO: 1997 - protein, 9 aa, Homo sapiens
  Light chain CDR3 for antibody 999 (IGKV1-12)
QQANSFPYS

SEQ ID NO: 1998 - protein, 9 aa, Homo sapiens
  Heavy chain CDR3 for antibody 999 (IGHV4/OR15-8)
ARVLGAMFT

SEQ ID NO: 1999 - protein, 8 aa, Homo sapiens
  Light chain CDR3 for antibody 1000 (IGKV3-11)
QQRSNWIT

SEQ ID NO: 2000 - protein, 9 aa, Homo sapiens
  Heavy chain CDR3 for antibody 1000 (IGHV1-46)
CGWGYGMDV

SEQ ID NO: 2001 - protein, 9 aa, Homo sapiens
  Light chain CDR3 for antibody 1001 (IGKV1-39)
QQSYSTPYS

SEQ ID NO: 2002 - protein, 17 aa, Homo sapiens
  Heavy chain CDR3 for antibody 1001 (IGHV1-2)
ARDSCSGGSCYSAWFDP

SEQ ID NO: 2003 - protein, 8 aa, Homo sapiens
  Light chain CDR3 for antibody 1002 (IGKV1-NL1)
QQYYSTRT

SEQ ID NO: 2004 - protein, 24 aa, Homo sapiens
  Heavy chain CDR3 for antibody 1002 (IGHV1-46)
AGPITMVRGVIIPDYYYYYYGMDV

SEQ ID NO: 2005 - protein, 9 aa, Homo sapiens
  Light chain CDR3 for antibody 1003 (IGKV1-39)
QQSYSTPPS

SEQ ID NO: 2006 - protein, 24 aa, Homo sapiens
  Heavy chain CDR3 for antibody 1003 (IGHV1-46)
AGPITMVRGVIIPDYYYYYYGMDV

SEQ ID NO: 2007 - protein, 11 aa, Homo sapiens
  Light chain CDR3 for antibody 1004 (IGKV3-11)
QQRSNWPPLFT

SEQ ID NO: 2008 - protein, 18 aa, Homo sapiens
  Heavy chain CDR3 for antibody 1004 (IGHV4-b)
ATAYCGGDCSRGWVAMGV

SEQ ID NO: 2009 - protein, 9 aa, Homo sapiens
  Light chain CDR3 for antibody 1005 (IGKV1-5)
QQYNSYSCT

SEQ ID NO: 2010 - protein, 17 aa, Homo sapiens
  Heavy chain CDR3 for antibody 1005 (IGHV4-31)
ARGATEYAAANVSGMDV

SEQ ID NO: 2011 - protein, 10 aa, Homo sapiens
  Light chain CDR3 for antibody 1006 (IGKV3-20)
QQYGRSPPIT

SEQ ID NO: 2012 - protein, 17 aa, Homo sapiens
  Heavy chain CDR3 for antibody 1006 (IGHV1-18)
ARDRSIDMVVVINPFDS

SEQ ID NO: 2013 - protein, 9 aa, Homo sapiens
  Light chain CDR3 for antibody 1007 (IGKV1-9)
QQLDIYPLT

SEQ ID NO: 2014 - protein, 14 aa, Homo sapiens
  Heavy chain CDR3 for antibody 1007 (IGHV3-23)
AKCSHNCQREYFQH

SEQ ID NO: 2015 - protein, 9 aa, Homo sapiens
  Light chain CDR3 for antibody 1008 (IGKV1-39)
QQSYSAPRT

SEQ ID NO: 2016 - protein, 15 aa, Homo sapiens
  Heavy chain CDR3 for antibody 1008 (IGHV1-2)
AREPGGQWLFPHFDF

SEQ ID NO: 2017 - protein, 10 aa, Homo sapiens
  Light chain CDR3 for antibody 1009 (IGKV3-11)
QQRGNWPSPT

SEQ ID NO: 2018 - protein, 13 aa, Homo sapiens
  Heavy chain CDR3 for antibody 1009 (IGHV1-8)
ARGGDIMASYVDY

SEQ ID NO: 2019 - protein, 8 aa, Homo sapiens
  Light chain CDR3 for antibody 1010 (IGKV3-20)
QQYGSSPT

SEQ ID NO: 2020 - protein, 15 aa, Homo sapiens
  Heavy chain CDR3 for antibody 1010 (IGHV1-69)
ARRDIGSGWSSHFDY

SEQ ID NO: 2021 - protein, 8 aa, Homo sapiens
  Light chain CDR3 for antibody 1011 (IGKV3-20)
QQYGSSPT

SEQ ID NO: 2022 - protein, 13 aa, Homo sapiens
  Heavy chain CDR3 for antibody 1011 (IGHV1-18)
AREDGDYVVSFDY

SEQ ID NO: 2023 - protein, 9 aa, Homo sapiens
  Light chain CDR3 for antibody 1012 (IGKV3-20)
QQYGTLPRT

SEQ ID NO: 2024 - protein, 8 aa, Homo sapiens
  Heavy chain CDR3 for antibody 1012 (IGHV4-59)
ARASRMDV

SEQ ID NO: 2025 - protein, 9 aa, Homo sapiens
  Light chain CDR3 for antibody 1013 (IGKV3-NL5)
QQYDSSFPT

SEQ ID NO: 2026 - protein, 13 aa, Homo sapiens
  Heavy chain CDR3 for antibody 1013 (IGHV3-53)
AARPSGRFGPYDY

SEQ ID NO: 2027 - protein, 9 aa, Homo sapiens
  Light chain CDR3 for antibody 1014 (IGKV1-39)
QQCFTSPWT

SEQ ID NO: 2028 - protein, 16 aa, Homo sapiens
  Heavy chain CDR3 for antibody 1014 (IGHV4-b)
TRAYYDILTGSWGMDV

SEQ ID NO: 2029 - protein, 9 aa, Homo sapiens
  Light chain CDR3 for antibody 1015 (IGKV1-39)
QQYHSYPWT

SEQ ID NO: 2030 - protein, 8 aa, Homo sapiens
  Heavy chain CDR3 for antibody 1015 (IGHV3-11)
AKEHRWGI

SEQ ID NO: 2031 - protein, 9 aa, Homo sapiens
  Light chain CDR3 for antibody 1016 (IGKV1-33)
QQYDDLPLT

SEQ ID NO: 2032 - protein, 11 aa, Homo sapiens
  Heavy chain CDR3 for antibody 1016 (IGHV4-59)
ARASYGNHFDY

SEQ ID NO: 2033 - protein, 10 aa, Homo sapiens
  Light chain CDR3 for antibody 1017 (IGKV3-15)
QQYNNWPPLT

SEQ ID NO: 2034 - protein, 18 aa, Homo sapiens
  Heavy chain CDR3 for antibody 1017 (IGHV4-34)
ARGEYSSSWYGFRNWFDP

SEQ ID NO: 2035 - protein, 10 aa, Homo sapiens
  Light chain CDR3 for antibody 1018 (IGKV3-20)
QQYGGSPPYT

SEQ ID NO: 2036 - protein, 17 aa, Homo sapiens
  Heavy chain CDR3 for antibody 1018 (IGHV1-69)
ARGPFELNDASEYALDV

SEQ ID NO: 2037 - protein, 9 aa, Homo sapiens
  Light chain CDR3 for antibody 1019 (IGKV1-39)
QQSYSTPPS

SEQ ID NO: 2038 - protein, 20 aa, Homo sapiens
  Heavy chain CDR3 for antibody 1019 (IGHV1-2)
ASGTYYYDSSGYYWNDAFDI

SEQ ID NO: 2039 - protein, 9 aa, Homo sapiens
  Light chain CDR3 for antibody 1020 (IGKV1-5)
QQYSGYPWT

SEQ ID NO: 2040 - protein, 12 aa, Homo sapiens
  Heavy chain CDR3 for antibody 1020 (IGHV4-61)
AGFLYGGGGRGP

SEQ ID NO: 2041 - protein, 9 aa, Homo sapiens
  Light chain CDR3 for antibody 1021 (IGKV1-12)
QQAYSYPLT

SEQ ID NO: 2042 - protein, 19 aa, Homo sapiens
  Heavy chain CDR3 for antibody 1021 (IGHV4-59)
ARDVDIVIRGAIAANWFDP

SEQ ID NO: 2043 - protein, 10 aa, Homo sapiens
  Light chain CDR3 for antibody 1022 (IGKV1-39)
QQSYSTPALT

SEQ ID NO: 2044 - protein, 16 aa, Homo sapiens
  Heavy chain CDR3 for antibody 1022 (IGHV4-61)
ARDGSYSSSWKNWFDP

SEQ ID NO: 2045 - protein, 9 aa, Homo sapiens
  Light chain CDR3 for antibody 1023 (IGKV3-20)
QQYGSSPPT

SEQ ID NO: 2046 - protein, 18 aa, Homo sapiens
  Heavy chain CDR3 for antibody 1023 (IGHV3-13)
ARGVSSSWGYYYYYYMDV

SEQ ID NO: 2047 - protein, 9 aa, Homo sapiens
  Light chain CDR3 for antibody 1024 (IGKV3-20)
QQYGNSLFT

SEQ ID NO: 2048 - protein, 9 aa, Homo sapiens
  Heavy chain CDR3 for antibody 1024 (IGHV3-23)
AKGRPRFDY

SEQ ID NO: 2049 - protein, 8 aa, Homo sapiens
  Light chain CDR3 for antibody 1025 (IGKV1-NL1)
QQYYSTRT

SEQ ID NO: 2050 - protein, 21 aa, Homo sapiens
  Heavy chain CDR3 for antibody 1025 (IGHV4/OR15-8)
ARDRGRYYDSSGYEEMYAFDI

SEQ ID NO: 2051 - protein, 9 aa, Homo sapiens
  Light chain CDR3 for antibody 1026 (IGKV1-5)
QQYNSYPYT

SEQ ID NO: 2052 - protein, 13 aa, Homo sapiens
  Heavy chain CDR3 for antibody 1026 (IGHV4-61)
ARHAHSTVVLFDI

SEQ ID NO: 2053 - protein, 8 aa, Homo sapiens
  Light chain CDR3 for antibody 1027 (IGKV3-20)
QQYGSSPT

SEQ ID NO: 2054 - protein, 16 aa, Homo sapiens
  Heavy chain CDR3 for antibody 1027 (IGHV3-13)
ARGRTPAASFYYYMDV

SEQ ID NO: 2055 - protein, 9 aa, Homo sapiens
  Light chain CDR3 for antibody 1028 (IGKV1-39)
QQSHNTPWT

SEQ ID NO: 2056 - protein, 16 aa, Homo sapiens
  Heavy chain CDR3 for antibody 1028 (IGHV3-74)
VGAGTDSSGWYVSWNY

SEQ ID NO: 2057 - protein, 9 aa, Homo sapiens
  Light chain CDR3 for antibody 1029 (IGKV2D-28)
MQALQTPRT

SEQ ID NO: 2058 - protein, 17 aa, Homo sapiens
  Heavy chain CDR3 for antibody 1029 (IGHV3-33)
AKDKYEWGYDEPNYFDY

SEQ ID NO: 2059 - protein, 10 aa, Homo sapiens
  Light chain CDR3 for antibody 1030 (IGKV1-39)
QQSYSTPALT

SEQ ID NO: 2060 - protein, 21 aa, Homo sapiens
  Heavy chain CDR3 for antibody 1030 (IGHV4/OR15-8)
ARDRGRYYDSSGYEEMYAFDI

SEQ ID NO: 2061 - protein, 9 aa, Homo sapiens
  Light chain CDR3 for antibody 1031 (IGKV3-20)
QQCGSPPLS

SEQ ID NO: 2062 - protein, 6 aa, Homo sapiens
  Heavy chain CDR3 for antibody 1031 (IGHV3-7)
GVPGGY

SEQ ID NO: 2063 - protein, 9 aa, Homo sapiens
  Light chain CDR3 for antibody 1032 (IGKV1-39)
QQSYSTPPS

SEQ ID NO: 2064 - protein, 13 aa, Homo sapiens
  Heavy chain CDR3 for antibody 1032 (IGHV4-b)
ARSPRGDFYYFDY

SEQ ID NO: 2065 - protein, 9 aa, Homo sapiens
  Light chain CDR3 for antibody 1033 (IGKV3-20)
QQYGSSPPT

SEQ ID NO: 2066 - protein, 9 aa, Homo sapiens
  Heavy chain CDR3 for antibody 1033 (IGHV4/OR15-8)
ARVLGAMFT

SEQ ID NO: 2067 - protein, 9 aa, Homo sapiens
  Light chain CDR3 for antibody 1034 (IGKV6-21)
HQSSSLPYS

SEQ ID NO: 2068 - protein, 24 aa, Homo sapiens
  Heavy chain CDR3 for antibody 1034 (IGHV1-46)
AGPITMVRGVIIPDYYYYYYGMDV

SEQ ID NO: 2069 - protein, 10 aa, Homo sapiens
  Light chain CDR3 for antibody 1035 (IGKV1-39)
QQSYSTPALT

SEQ ID NO: 2070 - protein, 12 aa, Homo sapiens
  Heavy chain CDR3 for antibody 1035 (IGHV1-69)
ARWGDYYDSSDY

SEQ ID NO: 2071 - protein, 10 aa, Homo sapiens
  Light chain CDR3 for antibody 1036 (IGKV1-39)
QQSYSTLALT

SEQ ID NO: 2072 - protein, 15 aa, Homo sapiens
  Heavy chain CDR3 for antibody 1036 (IGHV5-51)
ARREAAAGTGIHLGY

SEQ ID NO: 2073 - protein, 9 aa, Homo sapiens
  Light chain CDR3 for antibody 1037 (IGKV1-33)
QQYDNLPYS

SEQ ID NO: 2074 - protein, 9 aa, Homo sapiens
  Heavy chain CDR3 for antibody 1037 (IGHV4/OR15-8)
ARVLGAMFT

SEQ ID NO: 2075 - protein, 9 aa, Homo sapiens
  Light chain CDR3 for antibody 1038 (IGKV6-21)
HQSSSLPYS

SEQ ID NO: 2076 - protein, 12 aa, Homo sapiens
  Heavy chain CDR3 for antibody 1038 (IGHV1-69)
ARWGDYYDSSDY

SEQ ID NO: 2077 - protein, 9 aa, Homo sapiens
  Light chain CDR3 for antibody 1039 (IGKV3-20)
QQYGSSPPT

SEQ ID NO: 2078 - protein, 13 aa, Homo sapiens
  Heavy chain CDR3 for antibody 1039 (IGHV1-18)
AREDGDYVVSFDY

SEQ ID NO: 2079 - protein, 9 aa, Homo sapiens
  Light chain CDR3 for antibody 1040 (IGKV3-20)
QQYGSSPPT

SEQ ID NO: 2080 - protein, 13 aa, Homo sapiens
  Heavy chain CDR3 for antibody 1040 (IGHV4-b)
ARSPRGDFYYFDY

SEQ ID NO: 2081 - protein, 9 aa, Homo sapiens
  Light chain CDR3 for antibody 1041 (IGKV3-11)
QQRSTWLWT

SEQ ID NO: 2082 - protein, 17 aa, Homo sapiens
  Heavy chain CDR3 for antibody 1041 (IGHV1-69)
ARGTFSGYSPTLHWFDP

SEQ ID NO: 2083 - protein, 9 aa, Homo sapiens
  Light chain CDR3 for antibody 1042 (IGKV3-20)
QQYGSSPWT

SEQ ID NO: 2084 - protein, 12 aa, Homo sapiens
  Heavy chain CDR3 for antibody 1042 (IGHV3-74)
VRDGVGDPPFDY

SEQ ID NO: 2085 - protein, 9 aa, Homo sapiens
  Light chain CDR3 for antibody 1043 (IGKV1D-12)
QQGNSFPFT

SEQ ID NO: 2086 - protein, 13 aa, Homo sapiens
  Heavy chain CDR3 for antibody 1043 (IGHV3-66)
EKEDWESQPAFDF

SEQ ID NO: 2087 - protein, 9 aa, Homo sapiens
  Light chain CDR3 for antibody 1044 (IGKV1-12)
QQANSFPYS

SEQ ID NO: 2088 - protein, 16 aa, Homo sapiens
  Heavy chain CDR3 for antibody 1044 (IGHV4-61)
ARDGSYSSSWKNWFDP

SEQ ID NO: 2089 - protein, 9 aa, Homo sapiens
  Light chain CDR3 for antibody 1045 (IGKV3-20)
QQYGSAPRT

SEQ ID NO: 2090 - protein, 13 aa, Homo sapiens
  Heavy chain CDR3 for antibody 1045 (IGHV4-39)
ARDARAWGVGFDY

SEQ ID NO: 2091 - protein, 9 aa, Homo sapiens
  Light chain CDR3 for antibody 1046 (IGKV1-17)
LQHNTYPLT

SEQ ID NO: 2092 - protein, 11 aa, Homo sapiens
  Heavy chain CDR3 for antibody 1046 (IGHV1-8)
ARVHSRLTSHY

SEQ ID NO: 2093 - protein, 9 aa, Homo sapiens
  Light chain CDR3 for antibody 1047 (IGKV1-33)
QQYHNLPLT

SEQ ID NO: 2094 - protein, 19 aa, Homo sapiens
  Heavy chain CDR3 for antibody 1047 (IGHV1-18)
ACEDRGGLPQGVLMYGLDV

SEQ ID NO: 2095 - protein, 9 aa, Homo sapiens
  Light chain CDR3 for antibody 1048 (IGKV1-39)
QQSYSSPPT

SEQ ID NO: 2096 - protein, 12 aa, Homo sapiens
  Heavy chain CDR3 for antibody 1048 (IGHV1-18)
ARGFPSYDVPDS

SEQ ID NO: 2097 - protein, 8 aa, Homo sapiens
  Light chain CDR3 for antibody 1049 (IGKV1-37)
QRTYNAPT

SEQ ID NO: 2098 - protein, 10 aa, Homo sapiens
  Heavy chain CDR3 for antibody 1049 (IGHV3-72)
VASILVIANY

SEQ ID NO: 2099 - protein, 9 aa, Homo sapiens
  Light chain CDR3 for antibody 1050 (IGKV1-33)
QQYDNLPYS

SEQ ID NO: 2100 - protein, 21 aa, Homo sapiens
  Heavy chain CDR3 for antibody 1050 (IGHV4/OR15-8)
ARDRGRYYDSSGYEEMYAFDI

SEQ ID NO: 2101 - protein, 9 aa, Homo sapiens
  Light chain CDR3 for antibody 1051 (IGKV1-12)
QQANSFPYS

SEQ ID NO: 2102 - protein, 24 aa, Homo sapiens
  Heavy chain CDR3 for antibody 1051 (IGHV1-46)
AGPITMVRGVIIPDYYYYYYGMDV

SEQ ID NO: 2103 - protein, 9 aa, Homo sapiens
  Light chain CDR3 for antibody 1052 (IGKV1-17)
QQHDAYPLT

SEQ ID NO: 2104 - protein, 10 aa, Homo sapiens
  Heavy chain CDR3 for antibody 1052 (IGHV1-2)
ASGGSGAPDD

SEQ ID NO: 2105 - protein, 10 aa, Homo sapiens
  Light chain CDR3 for antibody 1053 (IGKV3-11)
QQRSNWPPYT

SEQ ID NO: 2106 - protein, 12 aa, Homo sapiens
  Heavy chain CDR3 for antibody 1053 (IGHV3-h)
ARVVWDEYYFDY

SEQ ID NO: 2107 - protein, 9 aa, Homo sapiens
  Light chain CDR3 for antibody 1054 (IGKV3D-15)
QHYINWPYS

SEQ ID NO: 2108 - protein, 12 aa, Homo sapiens
  Heavy chain CDR3 for antibody 1054 (IGHV5-51)
AKNGDAGGYFDL

SEQ ID NO: 2109 - protein, 9 aa, Homo sapiens
  Light chain CDR3 for antibody 1055 (IGKV1-39)
QQSYSTPRD

SEQ ID NO: 2110 - protein, 15 aa, Homo sapiens
  Heavy chain CDR3 for antibody 1055 (IGHV1-18)
ARALWWGDYYYYMDV

SEQ ID NO: 2111 - protein, 9 aa, Homo sapiens
  Light chain CDR3 for antibody 1056 (IGKV3-11)
QQRSNWPMT

SEQ ID NO: 2112 - protein, 15 aa, Homo sapiens
  Heavy chain CDR3 for antibody 1056 (IGHV3-23)
AKDLTATRGSSGFDY

SEQ ID NO: 2113 - protein, 9 aa, Homo sapiens
  Light chain CDR3 for antibody 1057 (IGKV1-39)
QQSYSTPYS

SEQ ID NO: 2114 - protein, 18 aa, Homo sapiens
  Heavy chain CDR3 for antibody 1057 (IGHV3-13)
ARGVSSSWGYYYYYYMDV

SEQ ID NO: 2115 - protein, 9 aa, Homo sapiens
  Light chain CDR3 for antibody 1058 (IGKV6-21)
HQSSSLPYS

SEQ ID NO: 2116 - protein, 20 aa, Homo sapiens
  Heavy chain CDR3 for antibody 1058 (IGHV1-2)
ASGTYYYDSSGYYWNDAFDI

SEQ ID NO: 2117 - protein, 9 aa, Homo sapiens
  Light chain CDR3 for antibody 1059 (IGKV1-12)
QQANSFPFT

SEQ ID NO: 2118 - protein, 12 aa, Homo sapiens
  Heavy chain CDR3 for antibody 1059 (IGHV3-48)
ARDPTSSLALDV

SEQ ID NO: 2119 - protein, 9 aa, Homo sapiens
  Light chain CDR3 for antibody 1060 (IGKV1-9)
QQVNSYPHT

SEQ ID NO: 2120 - protein, 16 aa, Homo sapiens
  Heavy chain CDR3 for antibody 1060 (IGHV1-69)
AIGEIPLNYYYYGMDV

SEQ ID NO: 2121 - protein, 8 aa, Homo sapiens
  Light chain CDR3 for antibody 1061 (IGKV1-39)
QQSYSART

SEQ ID NO: 2122 - protein, 15 aa, Homo sapiens
  Heavy chain CDR3 for antibody 1061 (IGHV1-2)
ARVDYDNYYKSGMDV

SEQ ID NO: 2123 - protein, 8 aa, Homo sapiens
  Light chain CDR3 for antibody 1062 (IGKV3-20)
QQYGSSPT

SEQ ID NO: 2124 - protein, 20 aa, Homo sapiens
  Heavy chain CDR3 for antibody 1062 (IGHV4-39)
ARTGHLIRFLEWLPINWFDP

SEQ ID NO: 2125 - protein, 9 aa, Homo sapiens
  Light chain CDR3 for antibody 1063 (IGKV3-11)
QQRSNWQYT

SEQ ID NO: 2126 - protein, 13 aa, Homo sapiens
  Heavy chain CDR3 for antibody 1063 (IGHV1-f)
ATDGPLSGSLFDY

SEQ ID NO: 2127 - protein, 6 aa, Homo sapiens
  Light chain CDR3 for antibody 1064 (IGKV1-33)
QQYDRT

SEQ ID NO: 2128 - protein, 14 aa, Homo sapiens
  Heavy chain CDR3 for antibody 1064 (IGHV3-48)
AKKKGGYNQHAFDI

SEQ ID NO: 2129 - protein, 9 aa, Homo sapiens
  Light chain CDR3 for antibody 1065 (IGKV3-20)
QQYGSFLLT

SEQ ID NO: 2130 - protein, 24 aa, Homo sapiens
  Heavy chain CDR3 for antibody 1065 (IGHV1-46)
AGPITMVRGVIIPDYYYYYYGMDV

SEQ ID NO: 2131 - protein, 8 aa, Homo sapiens
  Light chain CDR3 for antibody 1066 (IGKV1-NL1)
QQYYTTPT

SEQ ID NO: 2132 - protein, 14 aa, Homo sapiens
  Heavy chain CDR3 for antibody 1066 (IGHV1-18)
ARGPQTFSITYLDY

SEQ ID NO: 2133 - protein, 10 aa, Homo sapiens
  Light chain CDR3 for antibody 1067 (IGKV3-20)
QQYGGSPPYT

SEQ ID NO: 2134 - protein, 17 aa, Homo sapiens
  Heavy chain CDR3 for antibody 1067 (IGHV1-46)
ARVIHSEFLGTYGHFDY

SEQ ID NO: 2135 - protein, 9 aa, Homo sapiens
  Light chain CDR3 for antibody 1068 (IGKV1-39)
QQSYSTPIT

SEQ ID NO: 2136 - protein, 14 aa, Homo sapiens
  Heavy chain CDR3 for antibody 1068 (IGHV3-9)
TKDKAAGAGTVGDY

SEQ ID NO: 2137 - protein, 9 aa, Homo sapiens
  Light chain CDR3 for antibody 1069 (IGKV1-39)
QQSYSTPYT

SEQ ID NO: 2138 - protein, 13 aa, Homo sapiens
  Heavy chain CDR3 for antibody 1069 (IGHV4-39)
ARRLSSSDNQFDY

SEQ ID NO: 2139 - protein, 10 aa, Homo sapiens
  Light chain CDR3 for antibody 1070 (IGKV1-39)
QQSYSTPPWT

SEQ ID NO: 2140 - protein, 11 aa, Homo sapiens
  Heavy chain CDR3 for antibody 1070 (IGHV3-53)
ARDLQVYGMDV

SEQ ID NO: 2141 - protein, 8 aa, Homo sapiens
  Light chain CDR3 for antibody 1071 (IGKV3-20)
QQYGSSPT

SEQ ID NO: 2142 - protein, 23 aa, Homo sapiens
  Heavy chain CDR3 for antibody 1071 (IGHV1-69)
ARESSDTGIAVAGPSYYYYYMDV

SEQ ID NO: 2143 - protein, 9 aa, Homo sapiens
  Light chain CDR3 for antibody 1072 (IGKV3-20)
QQYGSSPPT

SEQ ID NO: 2144 - protein, 12 aa, Homo sapiens
  Heavy chain CDR3 for antibody 1072 (IGHV1-2)
ASGTYYYDSSDY

SEQ ID NO: 2145 - protein, 9 aa, Homo sapiens
  Light chain CDR3 for antibody 1073 (IGKV1-12)
QQANSFPYS

SEQ ID NO: 2146 - protein, 20 aa, Homo sapiens
  Heavy chain CDR3 for antibody 1073 (IGHV5-51)
ARLGVEQQLPPHPNYYGMDV

SEQ ID NO: 2147 - protein, 9 aa, Homo sapiens
  Light chain CDR3 for antibody 1074 (IGKV1-39)
QQSYDTPVT

SEQ ID NO: 2148 - protein, 12 aa, Homo sapiens
  Heavy chain CDR3 for antibody 1074 (IGHV1-69)
ARDAELRRGMDV

SEQ ID NO: 2149 - protein, 8 aa, Homo sapiens
  Light chain CDR3 for antibody 1075 (IGKV1-NL1)
QQYYSTRT

SEQ ID NO: 2150 - protein, 20 aa, Homo sapiens
  Heavy chain CDR3 for antibody 1075 (IGHV1-2)
ASGTYYYDSSGYYWNDAFDI

SEQ ID NO: 2151 - protein, 10 aa, Homo sapiens
  Light chain CDR3 for antibody 1076 (IGKV1-33)
QQYDNLPPLT

SEQ ID NO: 2152 - protein, 8 aa, Homo sapiens
  Heavy chain CDR3 for antibody 1076 (IGHV3-21)
ARGRDFMI

SEQ ID NO: 2153 - protein, 10 aa, Homo sapiens
  Light chain CDR3 for antibody 1077 (IGKV1-39)
QQSYSTPPWT

SEQ ID NO: 2154 - protein, 11 aa, Homo sapiens
  Heavy chain CDR3 for antibody 1077 (IGHV1-2)
ARYTGLEAFDY

SEQ ID NO: 2155 - protein, 9 aa, Homo sapiens
  Light chain CDR3 for antibody 1078 (IGKV3-20)
QQYGSSPPT

SEQ ID NO: 2156 - protein, 21 aa, Homo sapiens
  Heavy chain CDR3 for antibody 1078 (IGHV4/OR15-8)
ARDRGRYYDSSGYEEMYAFDI

SEQ ID NO: 2157 - protein, 10 aa, Homo sapiens
  Light chain CDR3 for antibody 1079 (IGKV3-11)
HQRSTWPSIT

SEQ ID NO: 2158 - protein, 12 aa, Homo sapiens
  Heavy chain CDR3 for antibody 1079 (IGHV1-69)
ARDNPQIAASDY

SEQ ID NO: 2159 - protein, 8 aa, Homo sapiens
  Light chain CDR3 for antibody 1080 (IGKV3-20)
QQYGSSPT

SEQ ID NO: 2160 - protein, 12 aa, Homo sapiens
  Heavy chain CDR3 for antibody 1080 (IGHV3-53)
ARDLGSVGATDY

SEQ ID NO: 2161 - protein, 9 aa, Homo sapiens
  Light chain CDR3 for antibody 1081 (IGKV3-11)
QQRSNWQYT

SEQ ID NO: 2162 - protein, 19 aa, Homo sapiens
  Heavy chain CDR3 for antibody 1081 (IGHV1-2)
ARDFGEMGTSLYYYYALAV

SEQ ID NO: 2163 - protein, 10 aa, Homo sapiens
  Light chain CDR3 for antibody 1082 (IGKV1-39)
QQSYSTPPWT

SEQ ID NO: 2164 - protein, 16 aa, Homo sapiens
  Heavy chain CDR3 for antibody 1082 (IGHV3-13)
ARGVSSSWGYYYYMDV

SEQ ID NO: 2165 - protein, 9 aa, Homo sapiens
  Light chain CDR3 for antibody 1083 (IGKV1D-12)
QQAYSFPLT

SEQ ID NO: 2166 - protein, 11 aa, Homo sapiens
  Heavy chain CDR3 for antibody 1083 (IGHV3-33)
ARKPSGWWVDY

SEQ ID NO: 2167 - protein, 8 aa, Homo sapiens
  Light chain CDR3 for antibody 1084 (IGKV3-11)
QQRSNGLT

SEQ ID NO: 2168 - protein, 16 aa, Homo sapiens
  Heavy chain CDR3 for antibody 1084 (IGHV3-23)
AKPIAVAGDATRYFDY

SEQ ID NO: 2169 - protein, 6 aa, Homo sapiens
  Light chain CDR3 for antibody 1085 (IGKV1-39)
QQSYGP

SEQ ID NO: 2170 - protein, 14 aa, Homo sapiens
  Heavy chain CDR3 for antibody 1085 (IGHV1-69)
VRDNDYSDLDWFDP

SEQ ID NO: 2171 - protein, 8 aa, Homo sapiens
  Light chain CDR3 for antibody 1086 (IGKV1-NL1)
QQYYSTRT

SEQ ID NO: 2172 - protein, 13 aa, Homo sapiens
  Heavy chain CDR3 for antibody 1086 (IGHV4-b)
ARSPRGDFYYFDY

SEQ ID NO: 2173 - protein, 9 aa, Homo sapiens
  Light chain CDR3 for antibody 1087 (IGKV1-5)
QQSNIFPWT

SEQ ID NO: 2174 - protein, 10 aa, Homo sapiens
  Heavy chain CDR3 for antibody 1087 (IGHV4-39)
VVGVRGWFDT

SEQ ID NO: 2175 - protein, 10 aa, Homo sapiens
  Light chain CDR3 for antibody 1088 (IGKV1-39)
QQSYSTPQYT

SEQ ID NO: 2176 - protein, 16 aa, Homo sapiens
  Heavy chain CDR3 for antibody 1088 (IGHV3-74)
VGAGTDSSGWYVSWNY

SEQ ID NO: 2177 - protein, 10 aa, Homo sapiens
  Light chain CDR3 for antibody 1089 (IGKV3-20)
QGYTTPAMYT

SEQ ID NO: 2178 - protein, 10 aa, Homo sapiens
  Heavy chain CDR3 for antibody 1089 (IGHV4/OR15-8)
ASHSGYSQGS

SEQ ID NO: 2179 - protein, 8 aa, Homo sapiens
  Light chain CDR3 for antibody 1090 (IGKV1-NL1)
QQYYSTRT

SEQ ID NO: 2180 - protein, 16 aa, Homo sapiens
  Heavy chain CDR3 for antibody 1090 (IGHV4-61)
ARDGSYSSSWKNWFDP

SEQ ID NO: 2181 - protein, 8 aa, Homo sapiens
  Light chain CDR3 for antibody 1091 (IGKV1-NL1)
QQYYSTRT

SEQ ID NO: 2182 - protein, 12 aa, Homo sapiens
  Heavy chain CDR3 for antibody 1091 (IGHV1-69)
ARWGDYYDSSDY

SEQ ID NO: 2183 - protein, 9 aa, Homo sapiens
  Light chain CDR3 for antibody 1092 (IGKV1-39)
QQIYRVPIT

SEQ ID NO: 2184 - protein, 11 aa, Homo sapiens
  Heavy chain CDR3 for antibody 1092 (IGHV2-70)
ARSYYDYVLDY

SEQ ID NO: 2185 - protein, 9 aa, Homo sapiens
  Light chain CDR3 for antibody 1093 (IGKV3-20)
QQYGSSPQT

SEQ ID NO: 2186 - protein, 10 aa, Homo sapiens
  Heavy chain CDR3 for antibody 1093 (IGHV2-5)
AHQRTADIDY

SEQ ID NO: 2187 - protein, 9 aa, Homo sapiens
  Light chain CDR3 for antibody 1094 (IGKV1-12)
QQANSFPYS

SEQ ID NO: 2188 - protein, 20 aa, Homo sapiens
  Heavy chain CDR3 for antibody 1094 (IGHV1-2)
ASGTYYYDSSGYYWNDAFDI

SEQ ID NO: 2189 - protein, 9 aa, Homo sapiens
  Light chain CDR3 for antibody 1095 (IGKV2D-28)
MQALQTLYT

SEQ ID NO: 2190 - protein, 16 aa, Homo sapiens
  Heavy chain CDR3 for antibody 1095 (IGHV4-31)
ARAFRVGSTRGRGIDS

SEQ ID NO: 2191 - protein, 10 aa, Homo sapiens
  Light chain CDR3 for antibody 1096 (IGKV3-11)
QQRSNWPALT

SEQ ID NO: 2192 - protein, 17 aa, Homo sapiens
  Heavy chain CDR3 for antibody 1096 (IGHV4/OR15-8)
ARGKGWFGSHFPYYMDV

SEQ ID NO: 2193 - protein, 9 aa, Homo sapiens
  Light chain CDR3 for antibody 1097 (IGKV1-39)
QQSYNPPWT

SEQ ID NO: 2194 - protein, 14 aa, Homo sapiens
  Heavy chain CDR3 for antibody 1097 (IGHV1-2)
ARDEDSVVVTAISE

SEQ ID NO: 2195 - protein, 9 aa, Homo sapiens
  Light chain CDR3 for antibody 1098 (IGKV1-39)
QQSYSTPLT

SEQ ID NO: 2196 - protein, 19 aa, Homo sapiens
  Heavy chain CDR3 for antibody 1098 (IGHV1-3)
ARAGSPLRFLEWLSSFFDY

SEQ ID NO: 2197 - protein, 9 aa, Homo sapiens
  Light chain CDR3 for antibody 1099 (IGKV1-5)
QQYNTYPLT

SEQ ID NO: 2198 - protein, 18 aa, Homo sapiens
  Heavy chain CDR3 for antibody 1099 (IGHV1-69)
ARAKAYYSDNSGYSIFDS

SEQ ID NO: 2199 - protein, 9 aa, Homo sapiens
  Light chain CDR3 for antibody 1100 (IGKV1-39)
QQSYSTPYS

SEQ ID NO: 2200 - protein, 9 aa, Homo sapiens
  Heavy chain CDR3 for antibody 1100 (IGHV4/OR15-8)
ARVLGAMFT

SEQ ID NO: 2201 - protein, 9 aa, Homo sapiens
  Light chain CDR3 for antibody 1101 (IGKV3-20)
QHYGTSSYT

SEQ ID NO: 2202 - protein, 18 aa, Homo sapiens
  Heavy chain CDR3 for antibody 1101 (IGHV3-23)
AKDLRDSGSQNYYYGMDV

SEQ ID NO: 2203 - protein, 9 aa, Homo sapiens
  Light chain CDR3 for antibody 1102 (IGKV1-39)
QQSYSTPRT

SEQ ID NO: 2204 - protein, 11 aa, Homo sapiens
  Heavy chain CDR3 for antibody 1102 (IGHV2-70)
ARTTPAIAADY

SEQ ID NO: 2205 - protein, 9 aa, Homo sapiens
  Light chain CDR3 for antibody 1103 (IGKV1-39)
QQSYSTPRT

SEQ ID NO: 2206 - protein, 19 aa, Homo sapiens
  Heavy chain CDR3 for antibody 1103 (IGHV4-b)
ARQSYSGSYFARGADAFDI

SEQ ID NO: 2207 - protein, 9 aa, Homo sapiens
  Light chain CDR3 for antibody 1104 (IGKV1-39)
QQSYSTPYS

SEQ ID NO: 2208 - protein, 12 aa, Homo sapiens
  Heavy chain CDR3 for antibody 1104 (IGHV1-69)
ARWGDYYDSSDY

SEQ ID NO: 2209 - protein, 10 aa, Homo sapiens
  Light chain CDR3 for antibody 1105 (IGKV3-11)
QQRSNWPPWT

SEQ ID NO: 2210 - protein, 14 aa, Homo sapiens
  Heavy chain CDR3 for antibody 1105 (IGHV4-39)
ASPPYCSGGSCRDY

SEQ ID NO: 2211 - protein, 9 aa, Homo sapiens
  Light chain CDR3 for antibody 1106 (IGKV1-16)
QQYNTYPWT

SEQ ID NO: 2212 - protein, 16 aa, Homo sapiens
  Heavy chain CDR3 for antibody 1106 (IGHV4-30-2)
ARGYYDTKNYYSPLGD

SEQ ID NO: 2213 - protein, 8 aa, Homo sapiens
  Light chain CDR3 for antibody 1107 (IGKV3-20)
QQYGSSPT

SEQ ID NO: 2214 - protein, 11 aa, Homo sapiens
  Heavy chain CDR3 for antibody 1107 (IGHV3-53)
ARDLQVYGMDV

SEQ ID NO: 2215 - protein, 9 aa, Homo sapiens
  Light chain CDR3 for antibody 1108 (IGKV1-39)
QQSYSTPPS

SEQ ID NO: 2216 - protein, 21 aa, Homo sapiens
  Heavy chain CDR3 for antibody 1108 (IGHV4/OR15-8)
ARDRGRYYDSSGYEEMYAFDI

SEQ ID NO: 2217 - protein, 9 aa, Homo sapiens
  Light chain CDR3 for antibody 1109 (IGKV1-9)
QQLNSYPQT

SEQ ID NO: 2218 - protein, 18 aa, Homo sapiens
  Heavy chain CDR3 for antibody 1109 (IGHV3-13)
ARGVSSSWGYYYYYYMDV

SEQ ID NO: 2219 - protein, 10 aa, Homo sapiens
  Light chain CDR3 for antibody 1110 (IGKV1-5)
QQYNNYSALS

SEQ ID NO: 2220 - protein, 9 aa, Homo sapiens
  Heavy chain CDR3 for antibody 1110 (IGHV1-69)
ARGDTWFDY

SEQ ID NO: 2221 - protein, 9 aa, Homo sapiens
  Light chain CDR3 for antibody 1111 (IGKV1-6)
LQDYSFPLT

SEQ ID NO: 2222 - protein, 10 aa, Homo sapiens
  Heavy chain CDR3 for antibody 1111 (IGHV3-33)
ARTSSGWNDY

SEQ ID NO: 2223 - protein, 9 aa, Homo sapiens
  Light chain CDR3 for antibody 1112 (IGKV3-20)
QQYGSSPPT

SEQ ID NO: 2224 - protein, 16 aa, Homo sapiens
  Heavy chain CDR3 for antibody 1112 (IGHV3-13)
ARGRTPAASFYYYMDV

SEQ ID NO: 2225 - protein, 9 aa, Homo sapiens
  Light chain CDR3 for antibody 1113 (IGKV4-1)
QQYYGTPLT

SEQ ID NO: 2226 - protein, 18 aa, Homo sapiens
  Heavy chain CDR3 for antibody 1113 (IGHV5-51)
ARPYQGPGVAEGERDTDL

SEQ ID NO: 2227 - protein, 9 aa, Homo sapiens
  Light chain CDR3 for antibody 1114 (IGKV1-39)
QQSYSAPLA

SEQ ID NO: 2228 - protein, 16 aa, Homo sapiens
  Heavy chain CDR3 for antibody 1114 (IGHV3-30)
AKDGEYVSGWYEPIDS

SEQ ID NO: 2229 - protein, 8 aa, Homo sapiens
  Light chain CDR3 for antibody 1115 (IGKV3-20)
QQYEISQT

SEQ ID NO: 2230 - protein, 18 aa, Homo sapiens
  Heavy chain CDR3 for antibody 1115 (IGHV1-18)
ARDYYDSSGYYPKNPLDN

SEQ ID NO: 2231 - protein, 9 aa, Homo sapiens
  Light chain CDR3 for antibody 1116 (IGKV1-27)
QKYNSALLT

SEQ ID NO: 2232 - protein, 18 aa, Homo sapiens
  Heavy chain CDR3 for antibody 1116 (IGHV4-31)
ARDRYSTTPWDYSSGLDV

SEQ ID NO: 2233 - protein, 9 aa, Homo sapiens
  Light chain CDR3 for antibody 1117 (IGKV3-15)
QQYDNWPWT

SEQ ID NO: 2234 - protein, 10 aa, Homo sapiens
  Heavy chain CDR3 for antibody 1117 (IGHV2-5)
AYQRTANVDY

SEQ ID NO: 2235 - protein, 9 aa, Homo sapiens
  Light chain CDR3 for antibody 1118 (IGKV1-39)
QQSYSTLTT

SEQ ID NO: 2236 - protein, 15 aa, Homo sapiens
  Heavy chain CDR3 for antibody 1118 (IGHV1-18)
AREGGTSTRAYAFHI

SEQ ID NO: 2237 - protein, 10 aa, Homo sapiens
  Light chain CDR3 for antibody 1119 (IGKV1-39)
QRSRGSPPLA

SEQ ID NO: 2238 - protein, 19 aa, Homo sapiens
  Heavy chain CDR3 for antibody 1119 (IGHV4-b)
ARHTPFYYDTSGYYAPFDY

SEQ ID NO: 2239 - protein, 9 aa, Homo sapiens
  Light chain CDR3 for antibody 1120 (IGKV1-39)
QQSYSIPIT

SEQ ID NO: 2240 - protein, 24 aa, Homo sapiens
  Heavy chain CDR3 for antibody 1120 (IGHV6-1)
ATSYGVYSGGWHRWGFDYYYALDV

SEQ ID NO: 2241 - protein, 9 aa, Homo sapiens
  Light chain CDR3 for antibody 1121 (IGKV1-39)
QQSYSTPPS

SEQ ID NO: 2242 - protein, 13 aa, Homo sapiens
  Heavy chain CDR3 for antibody 1121 (IGHV1-18)
AREDGDYVVSFDY

SEQ ID NO: 2243 - protein, 9 aa, Homo sapiens
  Light chain CDR3 for antibody 1122 (IGKV1-33)
QQYDNLPYS

SEQ ID NO: 2244 - protein, 20 aa, Homo sapiens
  Heavy chain CDR3 for antibody 1122 (IGHV1-2)
ASGTYYYDSSGYYWNDAFDI

SEQ ID NO: 2245 - protein, 8 aa, Homo sapiens
  Light chain CDR3 for antibody 1123 (IGKV1-NL1)
QQYYSTRT

SEQ ID NO: 2246 - protein, 18 aa, Homo sapiens
  Heavy chain CDR3 for antibody 1123 (IGHV3-13)
ARGVSSSWGYYYYYYMDV

SEQ ID NO: 2247 - protein, 9 aa, Homo sapiens
  Light chain CDR3 for antibody 1124 (IGKV1-27)
QKYNSAPHT

SEQ ID NO: 2248 - protein, 19 aa, Homo sapiens
  Heavy chain CDR3 for antibody 1124 (IGHV1-3)
ARAGSPLRFLEWLSSFFDY

SEQ ID NO: 2249 - protein, 9 aa, Homo sapiens
  Light chain CDR3 for antibody 1125 (IGKV3-20)
QQYGSSPPT

SEQ ID NO: 2250 - protein, 15 aa, Homo sapiens
  Heavy chain CDR3 for antibody 1125 (IGHV1-69)
ARFANYYDSRTGIDY

SEQ ID NO: 2251 - protein, 9 aa, Homo sapiens
  Light chain CDR3 for antibody 1126 (IGKV1-39)
QQSYSIPLT

SEQ ID NO: 2252 - protein, 21 aa, Homo sapiens
  Heavy chain CDR3 for antibody 1126 (IGHV4-31)
AREPCSGGVCRYPRPGDWFDP

SEQ ID NO: 2253 - protein, 10 aa, Homo sapiens
  Light chain CDR3 for antibody 1127 (IGKV3-11)
QQRSNWPPGT

SEQ ID NO: 2254 - protein, 17 aa, Homo sapiens
  Heavy chain CDR3 for antibody 1127 (IGHV1-69)
ARLGYCDSISCFDGMDV

SEQ ID NO: 2255 - protein, 9 aa, Homo sapiens
  Light chain CDR3 for antibody 1128 (IGKV1-12)
QQANSFPQT

SEQ ID NO: 2256 - protein, 11 aa, Homo sapiens
  Heavy chain CDR3 for antibody 1128 (IGHV1-69)
ATWGEWELIVY

SEQ ID NO: 2257 - protein, 9 aa, Homo sapiens
  Light chain CDR3 for antibody 1129 (IGKV1-39)
HQTYDTPQT

SEQ ID NO: 2258 - protein, 12 aa, Homo sapiens
  Heavy chain CDR3 for antibody 1129 (IGHV1-69)
ARDARLRGGMDV

SEQ ID NO: 2259 - protein, 10 aa, Homo sapiens
  Light chain CDR3 for antibody 1130 (IGKV1-39)
QQSYSTPPWT

SEQ ID NO: 2260 - protein, 22 aa, Homo sapiens
  Heavy chain CDR3 for antibody 1130 (IGHV3-66)
ARAHQKRIAAAGTNYYYYYMDV

SEQ ID NO: 2261 - protein, 11 aa, Homo sapiens
  Light chain CDR3 for antibody 1131 (IGKV1-39)
QQSYSNPPEDS

SEQ ID NO: 2262 - protein, 18 aa, Homo sapiens
  Heavy chain CDR3 for antibody 1131 (IGHV3-13)
ARGVSSSWGYYYYYYMDV

SEQ ID NO: 2263 - protein, 9 aa, Homo sapiens
  Light chain CDR3 for antibody 1132 (IGKV1-33)
QQYDNLPYS

SEQ ID NO: 2264 - protein, 24 aa, Homo sapiens
  Heavy chain CDR3 for antibody 1132 (IGHV1-46)
AGPITMVRGVIIPDYYYYYYGMDV

SEQ ID NO: 2265 - protein, 9 aa, Homo sapiens
  Light chain CDR3 for antibody 1133 (IGKV1-39)
QQSFTSPVT

SEQ ID NO: 2266 - protein, 13 aa, Homo sapiens
  Heavy chain CDR3 for antibody 1133 (IGHV2-5)
AHRRRRFLDAFHY

SEQ ID NO: 2267 - protein, 9 aa, Homo sapiens
  Light chain CDR3 for antibody 1134 (IGKV1-5)
QQYNSYSDT

SEQ ID NO: 2268 - protein, 13 aa, Homo sapiens
  Heavy chain CDR3 for antibody 1134 (IGHV1-8)
ARGDYYDSSGYDY

SEQ ID NO: 2269 - protein, 9 aa, Homo sapiens
  Light chain CDR3 for antibody 1135 (IGKV3-11)
QQRSTWLWT

SEQ ID NO: 2270 - protein, 9 aa, Homo sapiens
  Heavy chain CDR3 for antibody 1135 (IGHV1-18)
AKTGGISEH

SEQ ID NO: 2271 - protein, 10 aa, Homo sapiens
  Light chain CDR3 for antibody 1136 (IGKV1-39)
QQSYSTSMYT

SEQ ID NO: 2272 - protein, 25 aa, Homo sapiens
  Heavy chain CDR3 for antibody 1136 (IGHV4-b)
ARIHVDIVATILLGGYSYGYVYFDY

SEQ ID NO: 2273 - protein, 9 aa, Homo sapiens
  Light chain CDR3 for antibody 1137 (IGKV3-20)
HQYGSSPRT

SEQ ID NO: 2274 - protein, 19 aa, Homo sapiens
  Heavy chain CDR3 for antibody 1137 (IGHV4-59)
ARGRYYYDSNGVYWEWFDP

SEQ ID NO: 2275 - protein, 10 aa, Homo sapiens
  Light chain CDR3 for antibody 1138 (IGKV1-39)
QQSYSTLTWT

SEQ ID NO: 2276 - protein, 16 aa, Homo sapiens
  Heavy chain CDR3 for antibody 1138 (IGHV3-33)
VSYRPVYGYYRGRFDY

SEQ ID NO: 2277 - protein, 9 aa, Homo sapiens
  Light chain CDR3 for antibody 1139 (IGKV4-1)
QQYYSTPLT

SEQ ID NO: 2278 - protein, 11 aa, Homo sapiens
  Heavy chain CDR3 for antibody 1139 (IGHV1-58)
AAARGSYSFQH

SEQ ID NO: 2279 - protein, 9 aa, Homo sapiens
  Light chain CDR3 for antibody 1140 (IGKV3-20)
QHYGSSSYT

SEQ ID NO: 2280 - protein, 18 aa, Homo sapiens
  Heavy chain CDR3 for antibody 1140 (IGHV1-69)
AKERSSGWNGPAHYGMDV

SEQ ID NO: 2281 - protein, 8 aa, Homo sapiens
  Light chain CDR3 for antibody 1141 (IGKV3-20)
QQYGSSRS

SEQ ID NO: 2282 - protein, 20 aa, Homo sapiens
  Heavy chain CDR3 for antibody 1141 (IGHV1-69)
ARWGDYYDSSGYYWNDAFDI

SEQ ID NO: 2283 - protein, 9 aa, Homo sapiens
  Light chain CDR3 for antibody 1142 (IGKV1-33)
QQYDNLPYS

SEQ ID NO: 2284 - protein, 12 aa, Homo sapiens
  Heavy chain CDR3 for antibody 1142 (IGHV1-69)
ARWGDYYDSSDY

SEQ ID NO: 2285 - protein, 9 aa, Homo sapiens
  Light chain CDR3 for antibody 1143 (IGKV1-27)
QKYNSAPPV

SEQ ID NO: 2286 - protein, 16 aa, Homo sapiens
  Heavy chain CDR3 for antibody 1143 (IGHV1-2)
VREAPRVTATWRWFDV

SEQ ID NO: 2287 - protein, 9 aa, Homo sapiens
  Light chain CDR3 for antibody 1144 (IGKV1-39)
QQSYSTPRD

SEQ ID NO: 2288 - protein, 16 aa, Homo sapiens
  Heavy chain CDR3 for antibody 1144 (IGHV1-69)
AIGEIPLNYYYYGMDV

SEQ ID NO: 2289 - protein, 8 aa, Homo sapiens
  Light chain CDR3 for antibody 1145 (IGKV1-NL1)
QQYYSTRT

SEQ ID NO: 2290 - protein, 16 aa, Homo sapiens
  Heavy chain CDR3 for antibody 1145 (IGHV3-13)
ARGRTPAASFYYYMDV

SEQ ID NO: 2291 - protein, 9 aa, Homo sapiens
  Light chain CDR3 for antibody 1146 (IGKV3-20)
QQYGSSPPT

SEQ ID NO: 2292 - protein, 15 aa, Homo sapiens
  Heavy chain CDR3 for antibody 1146 (IGHV1-69)
ARRDIGSGWSSHFDY

SEQ ID NO: 2293 - protein, 9 aa, Homo sapiens
  Light chain CDR3 for antibody 1147 (IGKV1-33)
QQCHDLPYT

SEQ ID NO: 2294 - protein, 14 aa, Homo sapiens
  Heavy chain CDR3 for antibody 1147 (IGHV1-69)
ARDRDNWNRGFLDF

SEQ ID NO: 2295 - protein, 8 aa, Homo sapiens
  Light chain CDR3 for antibody 1148 (IGKV3-20)
QQYGSSPS

SEQ ID NO: 2296 - protein, 22 aa, Homo sapiens
  Heavy chain CDR3 for antibody 1148 (IGHV3-66)
ARAHQKRIAAAGTNYYYYYMDV

SEQ ID NO: 2297 - protein, 9 aa, Homo sapiens
  Light chain CDR3 for antibody 1149 (IGKV2D-28)
MQALQTSFT

SEQ ID NO: 2298 - protein, 20 aa, Homo sapiens
  Heavy chain CDR3 for antibody 1149 (IGHV5-51)
ARLGVEQQLPPHPNYYGMDV

SEQ ID NO: 2299 - protein, 8 aa, Homo sapiens
  Light chain CDR3 for antibody 1150 (IGKV1-5)
QQYNSPLT

SEQ ID NO: 2300 - protein, 12 aa, Homo sapiens
  Heavy chain CDR3 for antibody 1150 (IGHV4-b)
ARGGWLQFPFNY

SEQ ID NO: 2301 - protein, 9 aa, Homo sapiens
  Light chain CDR3 for antibody 1151 (IGKV3-20)
HQYGSSPIT

SEQ ID NO: 2302 - protein, 17 aa, Homo sapiens
  Heavy chain CDR3 for antibody 1151 (IGHV1-18)
ARALGKAVLGPGAVPDF

SEQ ID NO: 2303 - protein, 11 aa, Homo sapiens
  Light chain CDR3 for antibody 1152 (IGKV3-11)
QQRSNWPPALT

SEQ ID NO: 2304 - protein, 10 aa, Homo sapiens
  Heavy chain CDR3 for antibody 1152 (IGHV1-69)
AGNRDGSFDY

SEQ ID NO: 2305 - protein, 8 aa, Homo sapiens
  Light chain CDR3 for antibody 1153 (IGKV3-20)
QQYGSSRS

SEQ ID NO: 2306 - protein, 20 aa, Homo sapiens
  Heavy chain CDR3 for antibody 1153 (IGHV1-2)
ASGTYYYDSSGYYWNDSFDI

SEQ ID NO: 2307 - protein, 9 aa, Homo sapiens
  Light chain CDR3 for antibody 1154 (IGKV1-9)
QQLNSYPLT

SEQ ID NO: 2308 - protein, 15 aa, Homo sapiens
  Heavy chain CDR3 for antibody 1154 (IGHV1-2)
ARGIRYDSRGTYFDY

SEQ ID NO: 2309 - protein, 9 aa, Homo sapiens
  Light chain CDR3 for antibody 1155 (IGKV1-33)
QQYDNLPYS

SEQ ID NO: 2310 - protein, 20 aa, Homo sapiens
  Heavy chain CDR3 for antibody 1155 (IGHV5-51)
ARLGVEQQLPPHPNYYGMDV

SEQ ID NO: 2311 - protein, 9 aa, Homo sapiens
  Light chain CDR3 for antibody 1156 (IGKV1-16)
QQYHGYPLT

SEQ ID NO: 2312 - protein, 17 aa, Homo sapiens
  Heavy chain CDR3 for antibody 1156 (IGHV3-30)
AKASQFFWFGESRLTDY

SEQ ID NO: 2313 - protein, 9 aa, Homo sapiens
  Light chain CDR3 for antibody 1157 (IGKV2-30)
MQATHWPRM

SEQ ID NO: 2314 - protein, 8 aa, Homo sapiens
  Heavy chain CDR3 for antibody 1157 (IGHV3-48)
ARMNNMDV

SEQ ID NO: 2315 - protein, 9 aa, Homo sapiens
  Light chain CDR3 for antibody 1158 (IGKV1-12)
QQANSFPQT

SEQ ID NO: 2316 - protein, 14 aa, Homo sapiens
  Heavy chain CDR3 for antibody 1158 (IGHV1-69)
ATGFGGASGSWVDP

SEQ ID NO: 2317 - protein, 9 aa, Homo sapiens
  Light chain CDR3 for antibody 1159 (IGKV1-27)
QRYNGDPRT

SEQ ID NO: 2318 - protein, 12 aa, Homo sapiens
  Heavy chain CDR3 for antibody 1159 (IGHV3-33)
AKDRRGYSELDS

SEQ ID NO: 2319 - protein, 9 aa, Homo sapiens
  Light chain CDR3 for antibody 1160 (IGKV3-20)
QLYGSSPYT

SEQ ID NO: 2320 - protein, 19 aa, Homo sapiens
  Heavy chain CDR3 for antibody 1160 (IGHV3-23)
AKGEGYNGNYYYYYYAMDV

SEQ ID NO: 2321 - protein, 9 aa, Homo sapiens
  Light chain CDR3 for antibody 1161 (IGKV1-12)
QQANSFPLT

SEQ ID NO: 2322 - protein, 9 aa, Homo sapiens
  Heavy chain CDR3 for antibody 1161 (IGHV4-30-2)
VRGQDTFDI

SEQ ID NO: 2323 - protein, 9 aa, Homo sapiens
  Light chain CDR3 for antibody 1162 (IGKV1-33)
QHYDNSPFT

SEQ ID NO: 2324 - protein, 14 aa, Homo sapiens
  Heavy chain CDR3 for antibody 1162 (IGHV1-18)
AIPQINYGSGTYRD

SEQ ID NO: 2325 - protein, 10 aa, Homo sapiens
  Light chain CDR3 for antibody 1163 (IGKV1-39)
QQSFDTPPFT

SEQ ID NO: 2326 - protein, 17 aa, Homo sapiens
  Heavy chain CDR3 for antibody 1163 (IGHV3-21)
VRGELCTGGVCLGDFDH

SEQ ID NO: 2327 - protein, 9 aa, Homo sapiens
  Light chain CDR3 for antibody 1164 (IGKV1-39)
QQSYSTPPS

SEQ ID NO: 2328 - protein, 16 aa, Homo sapiens
  Heavy chain CDR3 for antibody 1164 (IGHV4-61)
ARDGSYSSSWKNWFDP

SEQ ID NO: 2329 - protein, 9 aa, Homo sapiens
  Light chain CDR3 for antibody 1165 (IGKV3-20)
HQYGSSPRT

SEQ ID NO: 2330 - protein, 15 aa, Homo sapiens
  Heavy chain CDR3 for antibody 1165 (IGHV1-24)
ATESAVGVVIYALVF

SEQ ID NO: 2331 - protein, 8 aa, Homo sapiens
  Light chain CDR3 for antibody 1166 (IGKV1-27)
QSYYSALA

SEQ ID NO: 2332 - protein, 16 aa, Homo sapiens
  Heavy chain CDR3 for antibody 1166 (IGHV5-51)
ARHRRVYSSPFDSFDI

SEQ ID NO: 2333 - protein, 9 aa, Homo sapiens
  Light chain CDR3 for antibody 1167 (IGKV1-39)
QQSYSTPPS

SEQ ID NO: 2334 - protein, 16 aa, Homo sapiens
  Heavy chain CDR3 for antibody 1167 (IGHV3-13)
ARGRTPAASFYYYMDV

SEQ ID NO: 2335 - protein, 9 aa, Homo sapiens
  Light chain CDR3 for antibody 1168 (IGKV1-39)
QQSYSTPLT

SEQ ID NO: 2336 - protein, 10 aa, Homo sapiens
  Heavy chain CDR3 for antibody 1168 (IGHV5-51)
ARHSGRNLDY

SEQ ID NO: 2337 - protein, 11 aa, Homo sapiens
  Light chain CDR3 for antibody 1169 (IGKV3-20)
QQYGSSPVMYT

SEQ ID NO: 2338 - protein, 20 aa, Homo sapiens
  Heavy chain CDR3 for antibody 1169 (IGHV5-51)
ARRRWGTSSSSKGRVYYFDY

SEQ ID NO: 2339 - protein, 10 aa, Homo sapiens
  Light chain CDR3 for antibody 1170 (IGKV3-20)
QQYGSSPSST

SEQ ID NO: 2340 - protein, 20 aa, Homo sapiens
  Heavy chain CDR3 for antibody 1170 (IGHV4-59)
ARGSDLRYFDWSYYYYGMDV

SEQ ID NO: 2341 - protein, 9 aa, Homo sapiens
  Light chain CDR3 for antibody 1171 (IGKV4-1)
QQYYSSPLT

SEQ ID NO: 2342 - protein, 17 aa, Homo sapiens
  Heavy chain CDR3 for antibody 1171 (IGHV1-46)
ARGRDQGNHGRHAFFDS

SEQ ID NO: 2343 - protein, 9 aa, Homo sapiens
  Light chain CDR3 for antibody 1172 (IGKV1-39)
QQSYSTPPS

SEQ ID NO: 2344 - protein, 16 aa, Homo sapiens
  Heavy chain CDR3 for antibody 1172 (IGHV5-51)
ARLQPPPYYYYYGMDV

SEQ ID NO: 2345 - protein, 10 aa, Homo sapiens
  Light chain CDR3 for antibody 1173 (IGKV1-12)
QQANSFLSLT

SEQ ID NO: 2346 - protein, 24 aa, Homo sapiens
  Heavy chain CDR3 for antibody 1173 (IGHV1-46)
ARDQAGLPSPRGYSYGYYYYGMDV

SEQ ID NO: 2347 - protein, 11 aa, Homo sapiens
  Light chain CDR3 for antibody 1174 (IGKV1-39)
QQSYSNPPEDS

SEQ ID NO: 2348 - protein, 21 aa, Homo sapiens
  Heavy chain CDR3 for antibody 1174 (IGHV3-13)
ARAHQKRIAAAGTNYYYYMDV

SEQ ID NO: 2349 - protein, 8 aa, Homo sapiens
  Light chain CDR3 for antibody 1175 (IGKV3-20)
QQYGSSPT

SEQ ID NO: 2350 - protein, 20 aa, Homo sapiens
  Heavy chain CDR3 for antibody 1175 (IGHV3-64)
AKTAGPYCSGGSCYSGNVDY

SEQ ID NO: 2351 - protein, 10 aa, Homo sapiens
  Light chain CDR3 for antibody 1176 (IGKV1-13)
QQFNSYPPLT

SEQ ID NO: 2352 - protein, 20 aa, Homo sapiens
  Heavy chain CDR3 for antibody 1176 (IGHV1-2)
ASGTYYYDSSGYYWNDAFDI

SEQ ID NO: 2353 - protein, 9 aa, Homo sapiens
  Light chain CDR3 for antibody 1177 (IGKV3-20)
QQYSNTPWT

SEQ ID NO: 2354 - protein, 15 aa, Homo sapiens
  Heavy chain CDR3 for antibody 1177 (IGHV1-2)
SAVGRGPWFGELFIP

SEQ ID NO: 2355 - protein, 10 aa, Homo sapiens
  Light chain CDR3 for antibody 1178 (IGKV1-13)
QQFNSYPPLT

SEQ ID NO: 2356 - protein, 18 aa, Homo sapiens
  Heavy chain CDR3 for antibody 1178 (IGHV3-13)
ARGVSSSWGYYYYYYMDV

SEQ ID NO: 2357 - protein, 9 aa, Homo sapiens
  Light chain CDR3 for antibody 1179 (IGKV3-20)
QQYGSSPPT

SEQ ID NO: 2358 - protein, 12 aa, Homo sapiens
  Heavy chain CDR3 for antibody 1179 (IGHV3-33)
AKDYPGNGYWVY

SEQ ID NO: 2359 - protein, 9 aa, Homo sapiens
  Light chain CDR3 for antibody 1180 (IGKV1-12)
QQANSFPLT

SEQ ID NO: 2360 - protein, 11 aa, Homo sapiens
  Heavy chain CDR3 for antibody 1180 (IGHV4-61)
TGHTGWHHSDY

SEQ ID NO: 2361 - protein, 9 aa, Homo sapiens
  Light chain CDR3 for antibody 1181 (IGKV1-12)
QQANSFPYS

SEQ ID NO: 2362 - protein, 12 aa, Homo sapiens
  Heavy chain CDR3 for antibody 1181 (IGHV1-69)
ARWGDYYDSSDY

SEQ ID NO: 2363 - protein, 9 aa, Homo sapiens
  Light chain CDR3 for antibody 1182 (IGKV1-17)
LQHHNYPIT

SEQ ID NO: 2364 - protein, 17 aa, Homo sapiens
  Heavy chain CDR3 for antibody 1182 (IGHV3-66)
ATAGEIRATIGNPLIDY

SEQ ID NO: 2365 - protein, 9 aa, Homo sapiens
  Light chain CDR3 for antibody 1183 (IGKV3-20)
QQYGSSPPT

SEQ ID NO: 2366 - protein, 16 aa, Homo sapiens
  Heavy chain CDR3 for antibody 1183 (IGHV4-61)
ARDGSYSSSWKNWFDP

SEQ ID NO: 2367 - protein, 10 aa, Homo sapiens
  Light chain CDR3 for antibody 1184 (IGKV1-39)
QQSYSTPPWT

SEQ ID NO: 2368 - protein, 15 aa, Homo sapiens
  Heavy chain CDR3 for antibody 1184 (IGHV1-69)
ARRDIGSGWSSHFDY

SEQ ID NO: 2369 - protein, 6 aa, Homo sapiens
  Light chain CDR3 for antibody 1185 (IGKV3-20)
QQGGMT

SEQ ID NO: 2370 - protein, 13 aa, Homo sapiens
  Heavy chain CDR3 for antibody 1185 (IGHV1-69)
AVPWDGSGWSFDH

SEQ ID NO: 2371 - protein, 9 aa, Homo sapiens
  Light chain CDR3 for antibody 1186 (IGKV3-20)
QQYGSSPWT

SEQ ID NO: 2372 - protein, 10 aa, Homo sapiens
  Heavy chain CDR3 for antibody 1186 (IGHV3-74)
TSNGYYSLEF

SEQ ID NO: 2373 - protein, 10 aa, Homo sapiens
  Light chain CDR3 for antibody 1187 (IGKV1-13)
QQFNSYPPLT

SEQ ID NO: 2374 - protein, 24 aa, Homo sapiens
  Heavy chain CDR3 for antibody 1187 (IGHV1-46)
AGPITMVRGVIIPDYYYYYYGMDV

SEQ ID NO: 2375 - protein, 11 aa, Homo sapiens
  Light chain CDR3 for antibody 1188 (IGKV1-33)
QQYDNLPPFLT

SEQ ID NO: 2376 - protein, 11 aa, Homo sapiens
  Heavy chain CDR3 for antibody 1188 (IGHV4-39)
ARGLLTYYFDY

SEQ ID NO: 2377 - protein, 9 aa, Homo sapiens
  Light chain CDR3 for antibody 1189 (IGKV3-20)
QSYGDSPYT

SEQ ID NO: 2378 - protein, 11 aa, Homo sapiens
  Heavy chain CDR3 for antibody 1189 (IGHV3-33)
ARDSAVLGFDP

SEQ ID NO: 2379 - protein, 8 aa, Homo sapiens
  Light chain CDR3 for antibody 1190 (IGKV1-NL1)
QQYYSTRT

SEQ ID NO: 2380 - protein, 20 aa, Homo sapiens
  Heavy chain CDR3 for antibody 1190 (IGHV5-51)
ARLGVEQQLPPHPNYYGMDV

SEQ ID NO: 2381 - protein, 8 aa, Homo sapiens
  Light chain CDR3 for antibody 1191 (IGKV3-20)
QQYEISQT

SEQ ID NO: 2382 - protein, 23 aa, Homo sapiens
  Heavy chain CDR3 for antibody 1191 (IGHV1-46)
ARDRDAVVVAATGSGISNYGMDV

SEQ ID NO: 2383 - protein, 9 aa, Homo sapiens
  Light chain CDR3 for antibody 1192 (IGKV3-15)
QQYYDWPWT

SEQ ID NO: 2384 - protein, 20 aa, Homo sapiens
  Heavy chain CDR3 for antibody 1192 (IGHV1-18)
ARAGDSERYYYEGYNYYMDV

SEQ ID NO: 2385 - protein, 8 aa, Homo sapiens
  Light chain CDR3 for antibody 1193 (IGKV3-20)
QQYGSSPT

SEQ ID NO: 2386 - protein, 12 aa, Homo sapiens
  Heavy chain CDR3 for antibody 1193 (IGHV1-69)
ARWGDYYDSSDY

SEQ ID NO: 2387 - protein, 9 aa, Homo sapiens
  Light chain CDR3 for antibody 1194 (IGKV1-33)
QQYDNLPYS

SEQ ID NO: 2388 - protein, 20 aa, Homo sapiens
  Heavy chain CDR3 for antibody 1194 (IGHV4-39)
ARTGHLIRFLEWLPINWFDP

SEQ ID NO: 2389 - protein, 8 aa, Homo sapiens
  Light chain CDR3 for antibody 1195 (IGKV3-20)
QQYGSSPT

SEQ ID NO: 2390 - protein, 24 aa, Homo sapiens
  Heavy chain CDR3 for antibody 1195 (IGHV1-46)
ARPITMVRGVIIPDYCYYYYGMDV

SEQ ID NO: 2391 - protein, 9 aa, Homo sapiens
  Light chain CDR3 for antibody 1196 (IGKV3-20)
QQYGSSPPT

SEQ ID NO: 2392 - protein, 11 aa, Homo sapiens
  Heavy chain CDR3 for antibody 1196 (IGHV3-53)
ARDLQVYGMDV

SEQ ID NO: 2393 - protein, 9 aa, Homo sapiens
  Light chain CDR3 for antibody 1197 (IGKV1-39)
QQSYSTPPS

SEQ ID NO: 2394 - protein, 22 aa, Homo sapiens
  Heavy chain CDR3 for antibody 1197 (IGHV3-66)
ARALQKRIAAAGTNYYYYYMDV

SEQ ID NO: 2395 - protein, 9 aa, Homo sapiens
  Light chain CDR3 for antibody 1198 (IGKV1-9)
QQLNSYPQT

SEQ ID NO: 2396 - protein, 9 aa, Homo sapiens
  Heavy chain CDR3 for antibody 1198 (IGHV4/OR15-8)
ARVLGAMFT

SEQ ID NO: 2397 - protein, 8 aa, Homo sapiens
  Light chain CDR3 for antibody 1199 (IGKV1-NL1)
QQYYSTRT

SEQ ID NO: 2398 - protein, 11 aa, Homo sapiens
  Heavy chain CDR3 for antibody 1199 (IGHV3-53)
ARDLQVYGMDV

SEQ ID NO: 2399 - protein, 9 aa, Homo sapiens
  Light chain CDR3 for antibody 1200 (IGKV3-20)
QQYGSSPLT

SEQ ID NO: 2400 - protein, 19 aa, Homo sapiens
  Heavy chain CDR3 for antibody 1200 (IGHV4-b)
ARHRPTTIFGVVIIDYMDV

SEQ ID NO: 2401 - protein, 9 aa, Homo sapiens
  Light chain CDR3 for antibody 1201 (IGKV1-33)
QHYDDFPLT

SEQ ID NO: 2402 - protein, 16 aa, Homo sapiens
  Heavy chain CDR3 for antibody 1201 (IGHV4-b)
AKVRTLVGLTFGAFDV

SEQ ID NO: 2403 - protein, 8 aa, Homo sapiens
  Light chain CDR3 for antibody 1202 (IGKV3-20)
QQYGSSRS

SEQ ID NO: 2404 - protein, 24 aa, Homo sapiens
  Heavy chain CDR3 for antibody 1202 (IGHV1-46)
AGPITMVRGVIIPDYYYYYYGMDV

SEQ ID NO: 2405 - protein, 10 aa, Homo sapiens
  Light chain CDR3 for antibody 1203 (IGKV3-20)
QQYGSSPSLT

SEQ ID NO: 2406 - protein, 24 aa, Homo sapiens
  Heavy chain CDR3 for antibody 1203 (IGHV3-11)
ARDPFYGSGSYIFWVHYYYYYMDV

SEQ ID NO: 2407 - protein, 9 aa, Homo sapiens
  Light chain CDR3 for antibody 1204 (IGKV1-33)
QQYDNLPYS

SEQ ID NO: 2408 - protein, 18 aa, Homo sapiens
  Heavy chain CDR3 for antibody 1204 (IGHV3-13)
ARGVSSSWGYYYYYYMDV

SEQ ID NO: 2409 - protein, 9 aa, Homo sapiens
  Light chain CDR3 for antibody 1205 (IGKV3-20)
QQYGSSPPT

SEQ ID NO: 2410 - protein, 20 aa, Homo sapiens
  Heavy chain CDR3 for antibody 1205 (IGHV5-51)
ARLGVEQQLPPHPNYYGMDV

SEQ ID NO: 2411 - protein, 9 aa, Homo sapiens
  Light chain CDR3 for antibody 1206 (IGKV1-9)
QQLNSYPQT

SEQ ID NO: 2412 - protein, 24 aa, Homo sapiens
  Heavy chain CDR3 for antibody 1206 (IGHV1-46)
AGPITMVRGVIIPDYYYYYYGMDV

SEQ ID NO: 2413 - protein, 9 aa, Homo sapiens
  Light chain CDR3 for antibody 1207 (IGKV1-12)
QQANSFPYS

SEQ ID NO: 2414 - protein, 18 aa, Homo sapiens
  Heavy chain CDR3 for antibody 1207 (IGHV3-13)
ARGVSSSWGYYYYYYMDV

SEQ ID NO: 2415 - protein, 9 aa, Homo sapiens
  Light chain CDR3 for antibody 1208 (IGKV1-33)
QHYDNLSLT

SEQ ID NO: 2416 - protein, 16 aa, Homo sapiens
  Heavy chain CDR3 for antibody 1208 (IGHV1-46)
AGPPLLRGYMFGSLGN

SEQ ID NO: 2417 - protein, 10 aa, Homo sapiens
  Light chain CDR3 for antibody 1209 (IGKV5-2)
LQHDNFHTWT

SEQ ID NO: 2418 - protein, 12 aa, Homo sapiens
  Heavy chain CDR3 for antibody 1209 (IGHV3-30)
TKDLSPTKVWDY

SEQ ID NO: 2419 - protein, 9 aa, Homo sapiens
  Light chain CDR3 for antibody 1210 (IGKV3-20)
QQYGSSPPT

SEQ ID NO: 2420 - protein, 23 aa, Homo sapiens
  Heavy chain CDR3 for antibody 1210 (IGHV1-69)
ARESSDTGIAVAGPSYYYYYMDV

SEQ ID NO: 2421 - protein, 10 aa, Homo sapiens
  Light chain CDR3 for antibody 1211 (IGKV1-39)
QQSYSTPALT

SEQ ID NO: 2422 - protein, 20 aa, Homo sapiens
  Heavy chain CDR3 for antibody 1211 (IGHV4-39)
ARTGHLIRFLEWLPINWFDP

SEQ ID NO: 2423 - protein, 11 aa, Homo sapiens
  Light chain CDR3 for antibody 1212 (IGKV1-39)
QQSYSNPPEDS

SEQ ID NO: 2424 - protein, 12 aa, Homo sapiens
  Heavy chain CDR3 for antibody 1212 (IGHV1-69)
ARWGDYYDSSDY

SEQ ID NO: 2425 - protein, 8 aa, Homo sapiens
  Light chain CDR3 for antibody 1213 (IGKV3-20)
QQYGSSPT

SEQ ID NO: 2426 - protein, 24 aa, Homo sapiens
  Heavy chain CDR3 for antibody 1213 (IGHV1-46)
ARPITMVRRVIIPDYYYYYYGMDV

SEQ ID NO: 2427 - protein, 9 aa, Homo sapiens
  Light chain CDR3 for antibody 1214 (IGKV1-9)
QQLNSYPQT

SEQ ID NO: 2428 - protein, 12 aa, Homo sapiens
  Heavy chain CDR3 for antibody 1214 (IGHV3-53)
ARDLGSVGATDY

SEQ ID NO: 2429 - protein, 10 aa, Homo sapiens
  Light chain CDR3 for antibody 1215 (IGKV1-39)
QQSYTSPRWT

SEQ ID NO: 2430 - protein, 8 aa, Homo sapiens
  Heavy chain CDR3 for antibody 1215 (IGHV4-39)
ATVAGIYY

SEQ ID NO: 2431 - protein, 8 aa, Homo sapiens
  Light chain CDR3 for antibody 1216 (IGKV3-20)
QQYGSSRS

SEQ ID NO: 2432 - protein, 24 aa, Homo sapiens
  Heavy chain CDR3 for antibody 1216 (IGHV1-69)
AGPITMVRRVIIPDYYYYYYCMDV

SEQ ID NO: 2433 - protein, 8 aa, Homo sapiens
  Light chain CDR3 for antibody 1217 (IGKV1-NL1)
QQYYSTRT

SEQ ID NO: 2434 - protein, 12 aa, Homo sapiens
  Heavy chain CDR3 for antibody 1217 (IGHV3-33)
AKDYPGNGYWVY

SEQ ID NO: 2435 - protein, 11 aa, Homo sapiens
  Light chain CDR3 for antibody 1218 (IGKV1-39)
QQSYSNPPEDS

SEQ ID NO: 2436 - protein, 17 aa, Homo sapiens
  Heavy chain CDR3 for antibody 1218 (IGHV3-13)
ARGVSSSWGYYYYYMDV

SEQ ID NO: 2437 - protein, 10 aa, Homo sapiens
  Light chain CDR3 for antibody 1219 (IGKV1-37)
QRTYNAPPYS

SEQ ID NO: 2438 - protein, 19 aa, Homo sapiens
  Heavy chain CDR3 for antibody 1219 (IGHV4-31)
ARDRDEATIFGYYYYGMDV

SEQ ID NO: 2439 - protein, 9 aa, Homo sapiens
  Light chain CDR3 for antibody 1220 (IGKV3-20)
QHYGSSSYT

SEQ ID NO: 2440 - protein, 24 aa, Homo sapiens
  Heavy chain CDR3 for antibody 1220 (IGHV1-46)
AGPITMVRGVIIPDYYYYYYGMDV

SEQ ID NO: 2441 - protein, 10 aa, Homo sapiens
  Light chain CDR3 for antibody 1221 (IGKV1-39)
QQSYSTPPWT

SEQ ID NO: 2442 - protein, 12 aa, Homo sapiens
  Heavy chain CDR3 for antibody 1221 (IGHV3-53)
ARDLGSVGATDY

SEQ ID NO: 2443 - protein, 9 aa, Homo sapiens
  Light chain CDR3 for antibody 1222 (IGKV1-12)
QQAKSLPLT

SEQ ID NO: 2444 - protein, 23 aa, Homo sapiens
  Heavy chain CDR3 for antibody 1222 (IGHV5-51)
ARHEVEEQQVSSHFYDYYYGLDV

SEQ ID NO: 2445 - protein, 9 aa, Homo sapiens
  Light chain CDR3 for antibody 1223 (IGKV3-20)
QQYGSSPLT

SEQ ID NO: 2446 - protein, 19 aa, Homo sapiens
  Heavy chain CDR3 for antibody 1223 (IGHV1-69)
ARVSRYGGSGSYYTTRFDY

SEQ ID NO: 2447 - protein, 8 aa, Homo sapiens
  Light chain CDR3 for antibody 1224 (IGKV3-20)
QQYGSSPT

SEQ ID NO: 2448 - protein, 24 aa, Homo sapiens
  Heavy chain CDR3 for antibody 1224 (IGHV1-46)
AAPITMVRGVIIPDYYYYYYGMHV

SEQ ID NO: 2449 - protein, 9 aa, Homo sapiens
  Light chain CDR3 for antibody 1225 (IGKV3-20)
QQYGSSPLT

SEQ ID NO: 2450 - protein, 11 aa, Homo sapiens
  Heavy chain CDR3 for antibody 1225 (IGHV1-69)
ARDDSLLPLGY

SEQ ID NO: 2451 - protein, 8 aa, Homo sapiens
  Light chain CDR3 for antibody 1226 (IGKV3-20)
QQYGSSPT

SEQ ID NO: 2452 - protein, 8 aa, Homo sapiens
  Heavy chain CDR3 for antibody 1226 (IGHV1-8)
ARGRVADY

SEQ ID NO: 2453 - protein, 9 aa, Homo sapiens
  Light chain CDR3 for antibody 1227 (IGKV2-30)
MQGTHWPPS

SEQ ID NO: 2454 - protein, 20 aa, Homo sapiens
  Heavy chain CDR3 for antibody 1227 (IGHV1-18)
ARDGTIYDYGDYRALDAFDI

SEQ ID NO: 2455 - protein, 10 aa, Homo sapiens
  Light chain CDR3 for antibody 1228 (IGKV1-39)
QQSYITPLYS

SEQ ID NO: 2456 - protein, 22 aa, Homo sapiens
  Heavy chain CDR3 for antibody 1228 (IGHV3-66)
ARAHQKRIAAAGTNYYYYYMDV

SEQ ID NO: 2457 - protein, 9 aa, Homo sapiens
  Light chain CDR3 for antibody 1229 (IGKV1-9)
QQLNSYPQT

SEQ ID NO: 2458 - protein, 12 aa, Homo sapiens
  Heavy chain CDR3 for antibody 1229 (IGHV1-69)
ARWGDYYDSSDY

SEQ ID NO: 2459 - protein, 10 aa, Homo sapiens
  Light chain CDR3 for antibody 1230 (IGKV1-9)
QQLNSYPPLT

SEQ ID NO: 2460 - protein, 21 aa, Homo sapiens
  Heavy chain CDR3 for antibody 1230 (IGHV4/OR15-8)
ARDRGRYYDSSGYEEMYAFDI

SEQ ID NO: 2461 - protein, 9 aa, Homo sapiens
  Light chain CDR3 for antibody 1231 (IGKV1-39)
QQSYSTPPS

SEQ ID NO: 2462 - protein, 11 aa, Homo sapiens
  Heavy chain CDR3 for antibody 1231 (IGHV3-53)
ARDLQVYGMDV

SEQ ID NO: 2463 - protein, 9 aa, Homo sapiens
  Light chain CDR3 for antibody 1232 (IGKV6-21)
HQSSSLPYS

SEQ ID NO: 2464 - protein, 16 aa, Homo sapiens
  Heavy chain CDR3 for antibody 1232 (IGHV4-61)
ARDGSYSSSWKNWFDP

SEQ ID NO: 2465 - protein, 10 aa, Homo sapiens
  Light chain CDR3 for antibody 1233 (IGKV1-33)
QQYDNLPSIT

SEQ ID NO: 2466 - protein, 18 aa, Homo sapiens
  Heavy chain CDR3 for antibody 1233 (IGHV1-69)
ARGLMVQGVIITGDAFDI

SEQ ID NO: 2467 - protein, 9 aa, Homo sapiens
  Light chain CDR3 for antibody 1234 (IGKV1-33)
QQYDNLPYS

SEQ ID NO: 2468 - protein, 12 aa, Homo sapiens
  Heavy chain CDR3 for antibody 1234 (IGHV3-33)
AKDYPGNGYWVY

SEQ ID NO: 2469 - protein, 10 aa, Homo sapiens
  Light chain CDR3 for antibody 1235 (IGKV1-13)
QQFNSYPPLT

SEQ ID NO: 2470 - protein, 12 aa, Homo sapiens
  Heavy chain CDR3 for antibody 1235 (IGHV1-69)
ARWGDYYDSSDY

SEQ ID NO: 2471 - protein, 9 aa, Homo sapiens
  Light chain CDR3 for antibody 1236 (IGKV3-20)
QQYGSFLLT

SEQ ID NO: 2472 - protein, 20 aa, Homo sapiens
  Heavy chain CDR3 for antibody 1236 (IGHV1-2)
ASGTYYYDSSGYYWNDAFDI

SEQ ID NO: 2473 - protein, 9 aa, Homo sapiens
  Light chain CDR3 for antibody 1237 (IGKV4-1)
QQYYTTPRT

SEQ ID NO: 2474 - protein, 24 aa, Homo sapiens
  Heavy chain CDR3 for antibody 1237 (IGHV4-61)
ARDLDCSGGYCYSSPDPGIYNMHV

SEQ ID NO: 2475 - protein, 9 aa, Homo sapiens
  Light chain CDR3 for antibody 1238 (IGKV1-17)
LQHNSYPWT

SEQ ID NO: 2476 - protein, 15 aa, Homo sapiens
  Heavy chain CDR3 for antibody 1238 (IGHV4-34)
ARETHSYPNYYGMDV

SEQ ID NO: 2477 - protein, 8 aa, Homo sapiens
  Light chain CDR3 for antibody 1239 (IGKV3-20)
QQYGSSPT

SEQ ID NO: 2478 - protein, 24 aa, Homo sapiens
  Heavy chain CDR3 for antibody 1239 (IGHV1-46)
ARPITMVREVIIPDYYYYYYGMDV

SEQ ID NO: 2479 - protein, 10 aa, Homo sapiens
  Light chain CDR3 for antibody 1240 (IGKV1-39)
QQSYSTPPWT

SEQ ID NO: 2480 - protein, 12 aa, Homo sapiens
  Heavy chain CDR3 for antibody 1240 (IGHV3-33)
AKDYPGNGYWVY

SEQ ID NO: 2481 - protein, 10 aa, Homo sapiens
  Light chain CDR3 for antibody 1241 (IGKV1-9)
QQLNGYPPFT

SEQ ID NO: 2482 - protein, 19 aa, Homo sapiens
  Heavy chain CDR3 for antibody 1241 (IGHV4-34)
ARAKDSSDLNTYYYYAMDV

SEQ ID NO: 2483 - protein, 9 aa, Homo sapiens
  Light chain CDR3 for antibody 1242 (IGKV1-27)
QKYNSAPWP

SEQ ID NO: 2484 - protein, 21 aa, Homo sapiens
  Heavy chain CDR3 for antibody 1242 (IGHV1-46)
ARGRTYYDVLTGSVASYYFDY

SEQ ID NO: 2485 - protein, 8 aa, Homo sapiens
  Light chain CDR3 for antibody 1243 (IGKV3-20)
QQYGSSPT

SEQ ID NO: 2486 - protein, 21 aa, Homo sapiens
  Heavy chain CDR3 for antibody 1243 (IGHV1-2)
AREIFSMTVVVDPTGYYGMDV

SEQ ID NO: 2487 - protein, 10 aa, Homo sapiens
  Light chain CDR3 for antibody 1244 (IGKV1-39)
QQSYSTPPWT

SEQ ID NO: 2488 - protein, 18 aa, Homo sapiens
  Heavy chain CDR3 for antibody 1244 (IGHV3-33)
AKDGAAMARGYYYYGMDV

SEQ ID NO: 2489 - protein, 9 aa, Homo sapiens
  Light chain CDR3 for antibody 1245 (IGKV1-5)
QQYNSFPIT

SEQ ID NO: 2490 - protein, 9 aa, Homo sapiens
  Heavy chain CDR3 for antibody 1245 (IGHV3-74)
ARGQYGDYS

SEQ ID NO: 2491 - protein, 9 aa, Homo sapiens
  Light chain CDR3 for antibody 1246 (IGKV1-39)
QQSYSAPLA

SEQ ID NO: 2492 - protein, 16 aa, Homo sapiens
  Heavy chain CDR3 for antibody 1246 (IGHV1-18)
ARYLFGFGEVLTPFDY

SEQ ID NO: 2493 - protein, 9 aa, Homo sapiens
  Light chain CDR3 for antibody 1247 (IGKV1-39)
QQTYSTQWT

SEQ ID NO: 2494 - protein, 14 aa, Homo sapiens
  Heavy chain CDR3 for antibody 1247 (IGHV1-69)
ARGASSGNYYYFGY

SEQ ID NO: 2495 - protein, 8 aa, Homo sapiens
  Light chain CDR3 for antibody 1248 (IGKV3-20)
QQYGSSPT

SEQ ID NO: 2496 - protein, 18 aa, Homo sapiens
  Heavy chain CDR3 for antibody 1248 (IGHV3-33)
AKDGAAMARGYYYYGMDV

SEQ ID NO: 2497 - protein, 9 aa, Homo sapiens
  Light chain CDR3 for antibody 1249 (IGKV1-12)
QQANSFPRT

SEQ ID NO: 2498 - protein, 26 aa, Homo sapiens
  Heavy chain CDR3 for antibody 1249 (IGHV4-34)
ARGSGYYDSSGYYWDVLHSVTYYFDY

SEQ ID NO: 2499 - protein, 8 aa, Homo sapiens
  Light chain CDR3 for antibody 1250 (IGKV3-20)
QQYGSSPT

SEQ ID NO: 2500 - protein, 24 aa, Homo sapiens
  Heavy chain CDR3 for antibody 1250 (IGHV1-69)
AGTITMVRGVIIADYYYYYDGMDV

SEQ ID NO: 2501 - protein, 8 aa, Homo sapiens
  Light chain CDR3 for antibody 1251 (IGKV3-20)
QQYGSSRS

SEQ ID NO: 2502 - protein, 12 aa, Homo sapiens
  Heavy chain CDR3 for antibody 1251 (IGHV3-53)
ARWGDYYEGIDY

SEQ ID NO: 2503 - protein, 10 aa, Homo sapiens
  Light chain CDR3 for antibody 1252 (IGKV1-9)
QQLNSYPPLT

SEQ ID NO: 2504 - protein, 13 aa, Homo sapiens
  Heavy chain CDR3 for antibody 1252 (IGHV4-b)
ARSPRGDFYYFDY

SEQ ID NO: 2505 - protein, 9 aa, Homo sapiens
  Light chain CDR3 for antibody 1253 (IGKV1-9)
QQLNSYPLT

SEQ ID NO: 2506 - protein, 16 aa, Homo sapiens
  Heavy chain CDR3 for antibody 1253 (IGHV1-8)
ARVGGYDILPNQPLDY

SEQ ID NO: 2507 - protein, 9 aa, Homo sapiens
  Light chain CDR3 for antibody 1254 (IGKV3-20)
QQYGSFLLT

SEQ ID NO: 2508 - protein, 18 aa, Homo sapiens
  Heavy chain CDR3 for antibody 1254 (IGHV3-13)
ARGVSSSWGYYYYYYMDV

SEQ ID NO: 2509 - protein, 8 aa, Homo sapiens
  Light chain CDR3 for antibody 1255 (IGKV3-20)
QQYGSSPT

SEQ ID NO: 2510 - protein, 24 aa, Homo sapiens
  Heavy chain CDR3 for antibody 1255 (IGHV1-69)
AGPITRVSGVIIPDYYYYYYGMNV

SEQ ID NO: 2511 - protein, 9 aa, Homo sapiens
  Light chain CDR3 for antibody 1256 (IGKV1-33)
QQYDNLPYS

SEQ ID NO: 2512 - protein, 15 aa, Homo sapiens
  Heavy chain CDR3 for antibody 1256 (IGHV1-69)
ARRDIGSGWSSHFDY

SEQ ID NO: 2513 - protein, 10 aa, Homo sapiens
  Light chain CDR3 for antibody 1257 (IGKV1-39)
QQSYSTPPWT

SEQ ID NO: 2514 - protein, 16 aa, Homo sapiens
  Heavy chain CDR3 for antibody 1257 (IGHV3-13)
ARVTYDSSGYLHWFDP

SEQ ID NO: 2515 - protein, 10 aa, Homo sapiens
  Light chain CDR3 for antibody 1258 (IGKV1-39)
QQSYSTPALT

SEQ ID NO: 2516 - protein, 13 aa, Homo sapiens
  Heavy chain CDR3 for antibody 1258 (IGHV1-18)
AREDGDYVVSFDY

SEQ ID NO: 2517 - protein, 8 aa, Homo sapiens
  Light chain CDR3 for antibody 1259 (IGKV3-20)
QQYGSSPS

SEQ ID NO: 2518 - protein, 15 aa, Homo sapiens
  Heavy chain CDR3 for antibody 1259 (IGHV1-69)
ARYTGDGYNRGDFDY

SEQ ID NO: 2519 - protein, 9 aa, Homo sapiens
  Light chain CDR3 for antibody 1260 (IGKV1-12)
QQANSFPYS

SEQ ID NO: 2520 - protein, 12 aa, Homo sapiens
  Heavy chain CDR3 for antibody 1260 (IGHV3-53)
ARDLGSVGATDY

SEQ ID NO: 2521 - protein, 10 aa, Homo sapiens
  Light chain CDR3 for antibody 1261 (IGKV1-39)
QQSYSTPPWT

SEQ ID NO: 2522 - protein, 7 aa, Homo sapiens
  Heavy chain CDR3 for antibody 1261 (IGHV3-13)
ARGVSSS

SEQ ID NO: 2523 - protein, 9 aa, Homo sapiens
  Light chain CDR3 for antibody 1262 (IGKV3-20)
QQYGSSPQT

SEQ ID NO: 2524 - protein, 13 aa, Homo sapiens
  Heavy chain CDR3 for antibody 1262 (IGHV1-69)
ARSDDYGGNSEGY

SEQ ID NO: 2525 - protein, 9 aa, Homo sapiens
  Light chain CDR3 for antibody 1263 (IGKV1-39)
QQSYSAPLA

SEQ ID NO: 2526 - protein, 15 aa, Homo sapiens
  Heavy chain CDR3 for antibody 1263 (IGHV1-24)
ATESAVGVVIYALVF

SEQ ID NO: 2527 - protein, 8 aa, Homo sapiens
  Light chain CDR3 for antibody 1264 (IGKV3-20)
QQYGSSPS

SEQ ID NO: 2528 - protein, 10 aa, Homo sapiens
  Heavy chain CDR3 for antibody 1264 (IGHV2-5)
AHQRTADIDY

SEQ ID NO: 2529 - protein, 9 aa, Homo sapiens
  Light chain CDR3 for antibody 1265 (IGKV1-12)
QQANSFPYS

SEQ ID NO: 2530 - protein, 16 aa, Homo sapiens
  Heavy chain CDR3 for antibody 1265 (IGHV3-13)
ARGRTPAASFYYYMDV

SEQ ID NO: 2531 - protein, 10 aa, Homo sapiens
  Light chain CDR3 for antibody 1266 (IGKV1-39)
QQSYSTPPWT

SEQ ID NO: 2532 - protein, 8 aa, Homo sapiens
  Heavy chain CDR3 for antibody 1266 (IGHV1-8)
ARGRVADY

SEQ ID NO: 2533 - protein, 10 aa, Homo sapiens
  Light chain CDR3 for antibody 1267 (IGKV1-39)
QQSYITPLYS

SEQ ID NO: 2534 - protein, 16 aa, Homo sapiens
  Heavy chain CDR3 for antibody 1267 (IGHV3-13)
ARGRTPAASFYYYMDV

SEQ ID NO: 2535 - protein, 10 aa, Homo sapiens
  Light chain CDR3 for antibody 1268 (IGKV1-39)
QQSYSTPALT

SEQ ID NO: 2536 - protein, 15 aa, Homo sapiens
  Heavy chain CDR3 for antibody 1268 (IGHV1-69)
ARFANYYDSRTGIDY

SEQ ID NO: 2537 - protein, 8 aa, Homo sapiens
  Light chain CDR3 for antibody 1269 (IGKV1-NL1)
QQYYSTRT

SEQ ID NO: 2538 - protein, 22 aa, Homo sapiens
  Heavy chain CDR3 for antibody 1269 (IGHV3-66)
ARAHQKRIAAAGTNYYYYYMDV

SEQ ID NO: 2539 - protein, 9 aa, Homo sapiens
  Light chain CDR3 for antibody 1270 (IGKV1-12)
QQANSFPYS

SEQ ID NO: 2540 - protein, 15 aa, Homo sapiens
  Heavy chain CDR3 for antibody 1270 (IGHV1-69)
ARRDIGIGWSSHFDY

SEQ ID NO: 2541 - protein, 9 aa, Homo sapiens
  Light chain CDR3 for antibody 1271 (IGKV6-21)
HQSSSLPYS

SEQ ID NO: 2542 - protein, 21 aa, Homo sapiens
  Heavy chain CDR3 for antibody 1271 (IGHV4/OR15-8)
ARDRGRYYDSSGYEEMYAFDI

SEQ ID NO: 2543 - protein, 10 aa, Homo sapiens
  Light chain CDR3 for antibody 1272 (IGKV1-39)
QQSYSTPALT

SEQ ID NO: 2544 - protein, 24 aa, Homo sapiens
  Heavy chain CDR3 for antibody 1272 (IGHV1-46)
AGPITMVRGVIIPDYYYYYYGIDV

SEQ ID NO: 2545 - protein, 9 aa, Homo sapiens
  Light chain CDR3 for antibody 1273 (IGKV6-21)
HQSSSLPYS

SEQ ID NO: 2546 - protein, 20 aa, Homo sapiens
  Heavy chain CDR3 for antibody 1273 (IGHV5-51)
ARLGVEQQLPPHPNYYGMDV

SEQ ID NO: 2547 - protein, 8 aa, Homo sapiens
  Light chain CDR3 for antibody 1274 (IGKV3-20)
QQYGSSPT

SEQ ID NO: 2548 - protein, 24 aa, Homo sapiens
  Heavy chain CDR3 for antibody 1274 (IGHV1-69)
AGTITKVRGVIIPDYYYYYYGMDD

SEQ ID NO: 2549 - protein, 9 aa, Homo sapiens
  Light chain CDR3 for antibody 1275 (IGKV1-12)
QQAKSVPWT

SEQ ID NO: 2550 - protein, 15 aa, Homo sapiens
  Heavy chain CDR3 for antibody 1275 (IGHV3-33)
ARDSGIVGALFYFDF

SEQ ID NO: 2551 - protein, 9 aa, Homo sapiens
  Light chain CDR3 for antibody 1276 (IGKV1-6)
LQDYNYPLT

SEQ ID NO: 2552 - protein, 12 aa, Homo sapiens
  Heavy chain CDR3 for antibody 1276 (IGHV4-34)
ARVRGNRGNFDY

SEQ ID NO: 2553 - protein, 8 aa, Homo sapiens
  Light chain CDR3 for antibody 1277 (IGKV3-11)
QQGRNWLT

SEQ ID NO: 2554 - protein, 17 aa, Homo sapiens
  Heavy chain CDR3 for antibody 1277 (IGHV1-46)
ANSYCIGSTCYNNWFDP

SEQ ID NO: 2555 - protein, 11 aa, Homo sapiens
  Light chain CDR3 for antibody 1278 (IGKV3-15)
QQYNNWPPMYT

SEQ ID NO: 2556 - protein, 12 aa, Homo sapiens
  Heavy chain CDR3 for antibody 1278 (IGHV1-69)
ARWGDYYDSSDY

SEQ ID NO: 2557 - protein, 8 aa, Homo sapiens
  Light chain CDR3 for antibody 1279 (IGKV3-20)
QQYGSSPT

SEQ ID NO: 2558 - protein, 24 aa, Homo sapiens
  Heavy chain CDR3 for antibody 1279 (IGHV1-f)
AAPITMVRGVIIPDYYHHYGGMDV

SEQ ID NO: 2559 - protein, 9 aa, Homo sapiens
  Light chain CDR3 for antibody 1280 (IGKV2D-28)
MQALQTSFT

SEQ ID NO: 2560 - protein, 13 aa, Homo sapiens
  Heavy chain CDR3 for antibody 1280 (IGHV4-b)
ARSPRGDFYYFDY

SEQ ID NO: 2561 - protein, 8 aa, Homo sapiens
  Light chain CDR3 for antibody 1281 (IGKV3-20)
QQYGSSPT

SEQ ID NO: 2562 - protein, 24 aa, Homo sapiens
  Heavy chain CDR3 for antibody 1281 (IGHV1-46)
AGPITMARGVILPEYYYYYYGMDA

SEQ ID NO: 2563 - protein, 9 aa, Homo sapiens
  Light chain CDR3 for antibody 1282 (IGKV3-20)
QQYGSFLLT

SEQ ID NO: 2564 - protein, 21 aa, Homo sapiens
  Heavy chain CDR3 for antibody 1282 (IGHV4/OR15-8)
ARDRGRYYDSSGYEEMYAFDI

SEQ ID NO: 2565 - protein, 8 aa, Homo sapiens
  Light chain CDR3 for antibody 1283 (IGKV3-20)
QQYGSSPT

SEQ ID NO: 2566 - protein, 24 aa, Homo sapiens
  Heavy chain CDR3 for antibody 1283 (IGHV1-46)
AGPSTMVRGVIIRDYYYYYYGIDV

SEQ ID NO: 2567 - protein, 10 aa, Homo sapiens
  Light chain CDR3 for antibody 1284 (IGKV1-9)
QQLNSYPRST

SEQ ID NO: 2568 - protein, 10 aa, Homo sapiens
  Heavy chain CDR3 for antibody 1284 (IGHV3-30)
ARDSGGQFDP

SEQ ID NO: 2569 - protein, 9 aa, Homo sapiens
  Light chain CDR3 for antibody 1285 (IGKV1-39)
QQSYTPGVT

SEQ ID NO: 2570 - protein, 16 aa, Homo sapiens
  Heavy chain CDR3 for antibody 1285 (IGHV1-2)
ARDPEGVTGGLYYFDY

SEQ ID NO: 2571 - protein, 10 aa, Homo sapiens
  Light chain CDR3 for antibody 1286 (IGKV1-13)
QQFNSYPPLT

SEQ ID NO: 2572 - protein, 16 aa, Homo sapiens
  Heavy chain CDR3 for antibody 1286 (IGHV3-13)
ARGRTPAASFYYYMDV

SEQ ID NO: 2573 - protein, 10 aa, Homo sapiens
  Light chain CDR3 for antibody 1287 (IGKV1-39)
QQSYSTPALT

SEQ ID NO: 2574 - protein, 20 aa, Homo sapiens
  Heavy chain CDR3 for antibody 1287 (IGHV5-51)
ARIGVEQQLPPHPNYYGMDV

SEQ ID NO: 2575 - protein, 8 aa, Homo sapiens
  Light chain CDR3 for antibody 1288 (IGKV3-20)
QQYGSSRS

SEQ ID NO: 2576 - protein, 17 aa, Homo sapiens
  Heavy chain CDR3 for antibody 1288 (IGHV3-23)
AKSHYCSGGRCYSVFDS

SEQ ID NO: 2577 - protein, 9 aa, Homo sapiens
  Light chain CDR3 for antibody 1289 (IGKV1-9)
QQLNSYPQT

SEQ ID NO: 2578 - protein, 18 aa, Homo sapiens
  Heavy chain CDR3 for antibody 1289 (IGHV3-33)
AKDGAAMARGYYYYGMDV

SEQ ID NO: 2579 - protein, 11 aa, Homo sapiens
  Light chain CDR3 for antibody 1290 (IGKV3-15)
QQYNNWPPMYT

SEQ ID NO: 2580 - protein, 20 aa, Homo sapiens
  Heavy chain CDR3 for antibody 1290 (IGHV1-2)
ASGTYYYDSSGYYWNDAFDI

SEQ ID NO: 2581 - protein, 8 aa, Homo sapiens
  Light chain CDR3 for antibody 1291 (IGKV3-11)
QQRSNWPT

SEQ ID NO: 2582 - protein, 20 aa, Homo sapiens
  Heavy chain CDR3 for antibody 1291 (IGHV1-2)
ASGTYYYDSSGYYWNDAFDI

SEQ ID NO: 2583 - protein, 9 aa, Homo sapiens
  Light chain CDR3 for antibody 1292 (IGKV1-39)
QQSYSTPPS

SEQ ID NO: 2584 - protein, 20 aa, Homo sapiens
  Heavy chain CDR3 for antibody 1292 (IGHV5-51)
ASLGVEQKLPPHPNYYGMDV

SEQ ID NO: 2585 - protein, 9 aa, Homo sapiens
  Light chain CDR3 for antibody 1293 (IGKV3-20)
QQYGSFLLT

SEQ ID NO: 2586 - protein, 15 aa, Homo sapiens
  Heavy chain CDR3 for antibody 1293 (IGHV1-69)
ARFANYYDSRTGIDY

SEQ ID NO: 2587 - protein, 9 aa, Homo sapiens
  Light chain CDR3 for antibody 1294 (IGKV1-39)
QQSYSTPWT

SEQ ID NO: 2588 - protein, 19 aa, Homo sapiens
  Heavy chain CDR3 for antibody 1294 (IGHV1-8)
ARGGDYVWGSYRQGGWFDP

SEQ ID NO: 2589 - protein, 8 aa, Homo sapiens
  Light chain CDR3 for antibody 1295 (IGKV3-20)
QQYGSSPT

SEQ ID NO: 2590 - protein, 24 aa, Homo sapiens
  Heavy chain CDR3 for antibody 1295 (IGHV1-46)
AGPITMVRGVIIPDYYHYYYGMHA

SEQ ID NO: 2591 - protein, 9 aa, Homo sapiens
  Light chain CDR3 for antibody 1296 (IGKV1-39)
QQSHSIPRT

SEQ ID NO: 2592 - protein, 13 aa, Homo sapiens
  Heavy chain CDR3 for antibody 1296 (IGHV1-69)
ARDVAAGGTLFDD

SEQ ID NO: 2593 - protein, 8 aa, Homo sapiens
  Light chain CDR3 for antibody 1297 (IGKV3-20)
QQYGSSPT

SEQ ID NO: 2594 - protein, 24 aa, Homo sapiens
  Heavy chain CDR3 for antibody 1297 (IGHV1/OR21-1)
AATITMVREVIIPDYYHYYYGMDV

SEQ ID NO: 2595 - protein, 10 aa, Homo sapiens
  Light chain CDR3 for antibody 1298 (IGKV3-15)
QQYYNWPPLT

SEQ ID NO: 2596 - protein, 12 aa, Homo sapiens
  Heavy chain CDR3 for antibody 1298 (IGHV1-69)
ARWGDYYDSSDY

SEQ ID NO: 2597 - protein, 9 aa, Homo sapiens
  Light chain CDR3 for antibody 1299 (IGKV3-15)
QQFYDWPWT

SEQ ID NO: 2598 - protein, 10 aa, Homo sapiens
  Heavy chain CDR3 for antibody 1299 (IGHV2-5)
AYQRTADVDY

SEQ ID NO: 2599 - protein, 11 aa, Homo sapiens
  Light chain CDR3 for antibody 1300 (IGKV1-27)
QQYGSSPVMYT

SEQ ID NO: 2600 - protein, 12 aa, Homo sapiens
  Heavy chain CDR3 for antibody 1300 (IGHV3-33)
AKDRRGYSELDS

SEQ ID NO: 2601 - protein, 9 aa, Homo sapiens
  Light chain CDR3 for antibody 1301 (IGKV2D-28)
MQALQTSFT

SEQ ID NO: 2602 - protein, 24 aa, Homo sapiens
  Heavy chain CDR3 for antibody 1301 (IGHV1-46)
AGPITMVRGVIIPDYYYYYYGMDV

SEQ ID NO: 2603 - protein, 10 aa, Homo sapiens
  Light chain CDR3 for antibody 1302 (IGKV3-11)
QQRSNWPPYT

SEQ ID NO: 2604 - protein, 24 aa, Homo sapiens
  Heavy chain CDR3 for antibody 1302 (IGHV1-46)
AGPITMVRGVIIPDYYYYYYGMDV

SEQ ID NO: 2605 - protein, 8 aa, Homo sapiens
  Light chain CDR3 for antibody 1303 (IGKV3-20)
QQYGSSRS

SEQ ID NO: 2606 - protein, 6 aa, Homo sapiens
  Heavy chain CDR3 for antibody 1303 (IGHV1-46)
ARWGDY

SEQ ID NO: 2607 - protein, 10 aa, Homo sapiens
  Light chain CDR3 for antibody 1304 (IGKV1-39)
QQSYITPLYS

SEQ ID NO: 2608 - protein, 18 aa, Homo sapiens
  Heavy chain CDR3 for antibody 1304 (IGHV3-13)
ARGVSSSWGYYYYYYMDV

SEQ ID NO: 2609 - protein, 9 aa, Homo sapiens
  Light chain CDR3 for antibody 1305 (IGKV1-5)
QHYHTYPYT

SEQ ID NO: 2610 - protein, 16 aa, Homo sapiens
  Heavy chain CDR3 for antibody 1305 (IGHV1-46)
AREGANYYNSGSYADN

SEQ ID NO: 2611 - protein, 8 aa, Homo sapiens
  Light chain CDR3 for antibody 1306 (IGKV3-20)
QQYGSSPS

SEQ ID NO: 2612 - protein, 12 aa, Homo sapiens
  Heavy chain CDR3 for antibody 1306 (IGHV3-33)
AKDYPGNGYWVY

SEQ ID NO: 2613 - protein, 8 aa, Homo sapiens
  Light chain CDR3 for antibody 1307 (IGKV3-20)
QQYGSSPT

SEQ ID NO: 2614 - protein, 17 aa, Homo sapiens
  Heavy chain CDR3 for antibody 1307 (IGHV1-69)
ARLGYCDSISCFDGMDV

SEQ ID NO: 2615 - protein, 9 aa, Homo sapiens
  Light chain CDR3 for antibody 1308 (IGKV3-20)
QQYGSFLLT

SEQ ID NO: 2616 - protein, 22 aa, Homo sapiens
  Heavy chain CDR3 for antibody 1308 (IGHV1-69)
ARESSDTGIAVAGPSYYYYMDV

SEQ ID NO: 2617 - protein, 9 aa, Homo sapiens
  Light chain CDR3 for antibody 1309 (IGKV3-20)
QQYGSSPPT

SEQ ID NO: 2618 - protein, 22 aa, Homo sapiens
  Heavy chain CDR3 for antibody 1309 (IGHV3-66)
ARAHQKRIAAAGTNYYYYYMDV

SEQ ID NO: 2619 - protein, 8 aa, Homo sapiens
  Light chain CDR3 for antibody 1310 (IGKV3-20)
QQYGSSPT

SEQ ID NO: 2620 - protein, 24 aa, Homo sapiens
  Heavy chain CDR3 for antibody 1310 (IGHV1-46)
AVPITIIRGVIIPDYYYYYYGMDV

SEQ ID NO: 2621 - protein, 8 aa, Homo sapiens
  Light chain CDR3 for antibody 1311 (IGKV1-NL1)
QQYYSTRT

SEQ ID NO: 2622 - protein, 12 aa, Homo sapiens
  Heavy chain CDR3 for antibody 1311 (IGHV3-53)
ARDLGSVGATDY

SEQ ID NO: 2623 - protein, 9 aa, Homo sapiens
  Light chain CDR3 for antibody 1312 (IGKV1-5)
QQYDSSPFT

SEQ ID NO: 2624 - protein, 12 aa, Homo sapiens
  Heavy chain CDR3 for antibody 1312 (IGHV1-2)
SRWIAVAAPESD

SEQ ID NO: 2625 - protein, 10 aa, Homo sapiens
  Light chain CDR3 for antibody 1313 (IGKV3-20)
QQYGGSPPYT

SEQ ID NO: 2626 - protein, 21 aa, Homo sapiens
  Heavy chain CDR3 for antibody 1313 (IGHV1-8)
AGTNLPGTYYYDSIGYDTFDY

SEQ ID NO: 2627 - protein, 9 aa, Homo sapiens
  Light chain CDR3 for antibody 1314 (IGKV1-12)
QQANSFPYS

SEQ ID NO: 2628 - protein, 21 aa, Homo sapiens
  Heavy chain CDR3 for antibody 1314 (IGHV4/OR15-8)
ARDRGRYYDSSGYYWNDAFDI

SEQ ID NO: 2629 - protein, 8 aa, Homo sapiens
  Light chain CDR3 for antibody 1315 (IGKV3-20)
QQYGSSPT

SEQ ID NO: 2630 - protein, 24 aa, Homo sapiens
  Heavy chain CDR3 for antibody 1315 (IGHV1-58)
AGPITKVREVIIPDYYYYYYCIDV

SEQ ID NO: 2631 - protein, 9 aa, Homo sapiens
  Light chain CDR3 for antibody 1316 (IGKV6-21)
HQSSSLPYS

SEQ ID NO: 2632 - protein, 13 aa, Homo sapiens
  Heavy chain CDR3 for antibody 1316 (IGHV4-b)
ARSPRGDFYYFDY

SEQ ID NO: 2633 - protein, 9 aa, Homo sapiens
  Light chain CDR3 for antibody 1317 (IGKV2D-28)
MQALQTSFT

SEQ ID NO: 2634 - protein, 12 aa, Homo sapiens
  Heavy chain CDR3 for antibody 1317 (IGHV1-69)
ARWGDYYDSSDY

SEQ ID NO: 2635 - protein, 10 aa, Homo sapiens
  Light chain CDR3 for antibody 1318 (IGKV1-39)
QQSYSTPALT

SEQ ID NO: 2636 - protein, 16 aa, Homo sapiens
  Heavy chain CDR3 for antibody 1318 (IGHV5-51)
ARLQPPPYYYYYGMDV

SEQ ID NO: 2637 - protein, 9 aa, Homo sapiens
  Light chain CDR3 for antibody 1319 (IGKV1-39)
QQSYSTPPS

SEQ ID NO: 2638 - protein, 12 aa, Homo sapiens
  Heavy chain CDR3 for antibody 1319 (IGHV3-33)
AKDYPGNGYWVY

SEQ ID NO: 2639 - protein, 9 aa, Homo sapiens
  Light chain CDR3 for antibody 1320 (IGKV1-39)
QQSHSLPVT

SEQ ID NO: 2640 - protein, 15 aa, Homo sapiens
  Heavy chain CDR3 for antibody 1320 (IGHV1-69)
ARVPRITGTTQYFDY

SEQ ID NO: 2641 - protein, 9 aa, Homo sapiens
  Light chain CDR3 for antibody 1321 (IGKV1-27)
QKYNSALET

SEQ ID NO: 2642 - protein, 8 aa, Homo sapiens
  Heavy chain CDR3 for antibody 1321 (IGHV3-53)
VTSPGAGN

SEQ ID NO: 2643 - protein, 8 aa, Homo sapiens
  Light chain CDR3 for antibody 1322 (IGKV3-20)
QQYGSSPT

SEQ ID NO: 2644 - protein, 24 aa, Homo sapiens
  Heavy chain CDR3 for antibody 1322 (IGHV1-46)
AGPIAMVRGVIIPGYYCYYYGMDV

SEQ ID NO: 2645 - protein, 8 aa, Homo sapiens
  Light chain CDR3 for antibody 1323 (IGKV3-20)
QQYGSSPT

SEQ ID NO: 2646 - protein, 24 aa, Homo sapiens
  Heavy chain CDR3 for antibody 1323 (IGHV1-46)
AGPIAMVGGVIMPDYYYYYYGMDV

SEQ ID NO: 2647 - protein, 11 aa, Homo sapiens
  Light chain CDR3 for antibody 1324 (IGKV1-39)
QQSYSNPPEDS

SEQ ID NO: 2648 - protein, 16 aa, Homo sapiens
  Heavy chain CDR3 for antibody 1324 (IGHV3-13)
ARGRTPAASFYYYMDV

SEQ ID NO: 2649 - protein, 8 aa, Homo sapiens
  Light chain CDR3 for antibody 1325 (IGKV3-20)
QQYGSSRS

SEQ ID NO: 2650 - protein, 9 aa, Homo sapiens
  Heavy chain CDR3 for antibody 1325 (IGHV4/OR15-8)
ARVLGAMYT

SEQ ID NO: 2651 - protein, 9 aa, Homo sapiens
  Light chain CDR3 for antibody 1326 (IGKV1-39)
QQSYNTPRT

SEQ ID NO: 2652 - protein, 19 aa, Homo sapiens
  Heavy chain CDR3 for antibody 1326 (IGHV4-34)
ARAKDSSDLNTYHYYAMDV

SEQ ID NO: 2653 - protein, 8 aa, Homo sapiens
  Light chain CDR3 for antibody 1327 (IGKV1-33)
QQYDTPST

SEQ ID NO: 2654 - protein, 8 aa, Homo sapiens
  Heavy chain CDR3 for antibody 1327 (IGHV3-30)
AKDGDKAT

SEQ ID NO: 2655 - protein, 8 aa, Homo sapiens
  Light chain CDR3 for antibody 1328 (IGKV3-20)
QQYGSSPT

SEQ ID NO: 2656 - protein, 24 aa, Homo sapiens
  Heavy chain CDR3 for antibody 1328 (IGHV1-69)
AGTITMVRGVIIPDYCYYYYGMDV

SEQ ID NO: 2657 - protein, 8 aa, Homo sapiens
  Light chain CDR3 for antibody 1329 (IGKV3-20)
QQYGSSPT

SEQ ID NO: 2658 - protein, 24 aa, Homo sapiens
  Heavy chain CDR3 for antibody 1329 (IGHVPD1-5)
PTPITMVREVIIPYYYYYYYGMHV

SEQ ID NO: 2659 - protein, 11 aa, Homo sapiens
  Light chain CDR3 for antibody 1330 (IGKV1-39)
QQSYSNPPEDS

SEQ ID NO: 2660 - protein, 21 aa, Homo sapiens
  Heavy chain CDR3 for antibody 1330 (IGHV4/OR15-8)
ARDRGRYYDSSGYEEMYAFDI

SEQ ID NO: 2661 - protein, 9 aa, Homo sapiens
  Light chain CDR3 for antibody 1331 (IGKV1-12)
QQANSFPYS

SEQ ID NO: 2662 - protein, 18 aa, Homo sapiens
  Heavy chain CDR3 for antibody 1331 (IGHV3-33)
AKDGAAMARGYYYYGMDV

SEQ ID NO: 2663 - protein, 9 aa, Homo sapiens
  Light chain CDR3 for antibody 1332 (IGKV6-21)
HQSSSLPYS

SEQ ID NO: 2664 - protein, 11 aa, Homo sapiens
  Heavy chain CDR3 for antibody 1332 (IGHV3-53)
ARDLQVYGMDV

SEQ ID NO: 2665 - protein, 11 aa, Homo sapiens
  Light chain CDR3 for antibody 1333 (IGKV1-39)
QQSYSNPPEDS

SEQ ID NO: 2666 - protein, 9 aa, Homo sapiens
  Heavy chain CDR3 for antibody 1333 (IGHV4/OR15-8)
ARVLGAMFT

SEQ ID NO: 2667 - protein, 9 aa, Homo sapiens
  Light chain CDR3 for antibody 1334 (IGKV3-20)
QQYGSSPFT

SEQ ID NO: 2668 - protein, 21 aa, Homo sapiens
  Heavy chain CDR3 for antibody 1334 (IGHV5-51)
ARQLYCATTTSCSSIWGYFHY

SEQ ID NO: 2669 - protein, 9 aa, Homo sapiens
  Light chain CDR3 for antibody 1335 (IGKV1-12)
QQANSFPYS

SEQ ID NO: 2670 - protein, 13 aa, Homo sapiens
  Heavy chain CDR3 for antibody 1335 (IGHV1-18)
AREDGDYVVSFDY

SEQ ID NO: 2671 - protein, 7 aa, Homo sapiens
  Light chain CDR3 for antibody 1336 (IGKV3-20)
QQYGSSL

SEQ ID NO: 2672 - protein, 11 aa, Homo sapiens
  Heavy chain CDR3 for antibody 1336 (IGHV3-53)
ARGHWEYYFDY

SEQ ID NO: 2673 - protein, 9 aa, Homo sapiens
  Light chain CDR3 for antibody 1337 (IGKV3-20)
QQYGSSLWT

SEQ ID NO: 2674 - protein, 16 aa, Homo sapiens
  Heavy chain CDR3 for antibody 1337 (IGHV1-58)
AAPYCSGGSCFDAFDI

SEQ ID NO: 2675 - protein, 9 aa, Homo sapiens
  Light chain CDR3 for antibody 1338 (IGKV1-33)
QQYDNLPRT

SEQ ID NO: 2676 - protein, 13 aa, Homo sapiens
  Heavy chain CDR3 for antibody 1338 (IGHV3-53)
ARDGYCRGGSCYH

SEQ ID NO: 2677 - protein, 9 aa, Homo sapiens
  Light chain CDR3 for antibody 1339 (IGKV1-33)
QQYDNLPQT

SEQ ID NO: 2678 - protein, 12 aa, Homo sapiens
  Heavy chain CDR3 for antibody 1339 (IGHV3-53)
ARPTLSRGGMDV

SEQ ID NO: 2679 - protein, 8 aa, Homo sapiens
  Light chain CDR3 for antibody 1340 (IGKV1-12)
QQANSFPL

SEQ ID NO: 2680 - protein, 11 aa, Homo sapiens
  Heavy chain CDR3 for antibody 1340 (IGHV3-53)
ARDRYSYGLDY

SEQ ID NO: 2681 - protein, 9 aa, Homo sapiens
  Light chain CDR3 for antibody 1341 (IGKV1-5)
QQYNSYSRT

SEQ ID NO: 2682 - protein, 13 aa, Homo sapiens
  Heavy chain CDR3 for antibody 1341 (IGHV5-51)
ARQLCGGDCAFDY

SEQ ID NO: 2683 - protein, 9 aa, Homo sapiens
  Light chain CDR3 for antibody 1342 (IGKV1-9)
QQLNSDPPP

SEQ ID NO: 2684 - protein, 11 aa, Homo sapiens
  Heavy chain CDR3 for antibody 1342 (IGHV3-53)
ARDRVVYGMDV

SEQ ID NO: 2685 - protein, 8 aa, Homo sapiens
  Light chain CDR3 for antibody 1343 (IGKV3-15)
QQYNNWGT

SEQ ID NO: 2686 - protein, 15 aa, Homo sapiens
  Heavy chain CDR3 for antibody 1343 (IGHV1-69)
ARGQGPYSYYYYMDV

SEQ ID NO: 2687 - protein, 9 aa, Homo sapiens
  Light chain CDR3 for antibody 1344 (IGKV1-27)
QKYNSVSDT

SEQ ID NO: 2688 - protein, 11 aa, Homo sapiens
  Heavy chain CDR3 for antibody 1344 (IGHV3-53)
ARDRGSGWYDY

SEQ ID NO: 2689 - protein, 9 aa, Homo sapiens
  Light chain CDR3 for antibody 1345 (IGKV1-5)
QHYNIYPYT

SEQ ID NO: 2690 - protein, 13 aa, Homo sapiens
  Heavy chain CDR3 for antibody 1345 (IGHV3-23)
AKDSRGSTDYFDY

SEQ ID NO: 2691 - protein, 8 aa, Homo sapiens
  Light chain CDR3 for antibody 1346 (IGKV1-5)
QQYNSYSA

SEQ ID NO: 2692 - protein, 17 aa, Homo sapiens
  Heavy chain CDR3 for antibody 1346 (IGHV1-69)
ARGPPLPSSGWSEIWVY

SEQ ID NO: 2693 - protein, 10 aa, Homo sapiens
  Light chain CDR3 for antibody 1347 (IGKV1-39)
QQSYSTPPWT

SEQ ID NO: 2694 - protein, 16 aa, Homo sapiens
  Heavy chain CDR3 for antibody 1347 (IGHV3-64)
ARDSGDSPALVTWFDY

SEQ ID NO: 2695 - protein, 9 aa, Homo sapiens
  Light chain CDR3 for antibody 1348 (IGKV1-5)
QQYNSYPWT

SEQ ID NO: 2696 - protein, 19 aa, Homo sapiens
  Heavy chain CDR3 for antibody 1348 (IGHV1-3)
ATGLGKHDYSNYVVDYMDV

SEQ ID NO: 2697 - protein, 10 aa, Homo sapiens
  Light chain CDR3 for antibody 1349 (IGKV1-39)
QQSYSTPPIT

SEQ ID NO: 2698 - protein, 11 aa, Homo sapiens
  Heavy chain CDR3 for antibody 1349 (IGHV3-21)
AREVSVTDFDY

SEQ ID NO: 2699 - protein, 9 aa, Homo sapiens
  Light chain CDR3 for antibody 1350 (IGKV3-20)
QQYGSSPRT

SEQ ID NO: 2700 - protein, 11 aa, Homo sapiens
  Heavy chain CDR3 for antibody 1350 (IGHV3-53)
ARDYGDFYFDY

SEQ ID NO: 2701 - protein, 10 aa, Homo sapiens
  Light chain CDR3 for antibody 1351 (IGKV3-11)
QQRSNWPAGT

SEQ ID NO: 2702 - protein, 9 aa, Homo sapiens
  Heavy chain CDR3 for antibody 1351 (IGHV3-53)
ARDAPENGD

SEQ ID NO: 2703 - protein, 9 aa, Homo sapiens
  Light chain CDR3 for antibody 1352 (IGKV1-9)
QQLNSYPLT

SEQ ID NO: 2704 - protein, 11 aa, Homo sapiens
  Heavy chain CDR3 for antibody 1352 (IGHV3-53)
ARDIVVYGMDV

SEQ ID NO: 2705 - protein, 9 aa, Homo sapiens
  Light chain CDR3 for antibody 1353 (IGKV1-5)
QQYNSYPYT

SEQ ID NO: 2706 - protein, 14 aa, Homo sapiens
  Heavy chain CDR3 for antibody 1353 (IGHV4-39)
ASGDYGDYHRGFDY

SEQ ID NO: 2707 - protein, 9 aa, Homo sapiens
  Light chain CDR3 for antibody 1354 (IGKV1-33)
QQYDNLPIT

SEQ ID NO: 2708 - protein, 14 aa, Homo sapiens
  Heavy chain CDR3 for antibody 1354 (IGHV3-53)
ARLFYGGNSAGVDY

SEQ ID NO: 2709 - protein, 7 aa, Homo sapiens
  Light chain CDR3 for antibody 1355 (IGKV1-9)
QQLNSYS

SEQ ID NO: 2710 - protein, 11 aa, Homo sapiens
  Heavy chain CDR3 for antibody 1355 (IGHV3-53)
ARDLAVYGMDV

SEQ ID NO: 2711 - protein, 9 aa, Homo sapiens
  Light chain CDR3 for antibody 1356 (IGKV1-39)
QQSYSTPLT

SEQ ID NO: 2712 - protein, 20 aa, Homo sapiens
  Heavy chain CDR3 for antibody 1356 (IGHV3-30)
AKEEGKRWLQIYYYYYGMDV

SEQ ID NO: 2713 - protein, 10 aa, Homo sapiens
  Light chain CDR3 for antibody 1357 (IGKV1-39)
QQSYSNGSGT

SEQ ID NO: 2714 - protein, 12 aa, Homo sapiens
  Heavy chain CDR3 for antibody 1357 (IGHV3-53)
ARDLFEAGGMDV

SEQ ID NO: 2715 - protein, 9 aa, Homo sapiens
  Light chain CDR3 for antibody 1358 (IGKV1-39)
QQNLVIPRA

SEQ ID NO: 2716 - protein, 12 aa, Homo sapiens
  Heavy chain CDR3 for antibody 1358 (IGHV3-15)
TTDSRTLYALDV

SEQ ID NO: 2717 - protein, 8 aa, Homo sapiens
  Light chain CDR3 for antibody 1359 (IGKV1-5)
QQYNTLYT

SEQ ID NO: 2718 - protein, 11 aa, Homo sapiens
  Heavy chain CDR3 for antibody 1359 (IGHV5-51)
ARSPTTNTFDY

SEQ ID NO: 2719 - protein, 9 aa, Homo sapiens
  Light chain CDR3 for antibody 1360 (IGKV1-12)
QQANSFPPT

SEQ ID NO: 2720 - protein, 21 aa, Homo sapiens
  Heavy chain CDR3 for antibody 1360 (IGHV2-5)
AQRLGYCSSTSCYNRFVAFDI

SEQ ID NO: 2721 - protein, 10 aa, Homo sapiens
  Light chain CDR3 for antibody 1361 (IGKV1-9)
QQLNSYPPVT

SEQ ID NO: 2722 - protein, 11 aa, Homo sapiens
  Heavy chain CDR3 for antibody 1361 (IGHV3-53)
ARDLDYYGMDV

SEQ ID NO: 2723 - protein, 8 aa, Homo sapiens
  Light chain CDR3 for antibody 1362 (IGKV4-1)
QQYYSTPS

SEQ ID NO: 2724 - protein, 19 aa, Homo sapiens
  Heavy chain CDR3 for antibody 1362 (IGHV1-69)
AEGRALTLSYSSSYGAFDY

SEQ ID NO: 2725 - protein, 10 aa, Homo sapiens
  Light chain CDR3 for antibody 1363 (IGKV3-20)
QQYGSSPPWT

SEQ ID NO: 2726 - protein, 14 aa, Homo sapiens
  Heavy chain CDR3 for antibody 1363 (IGHV1-69)
ARYGVSYGDYLPDY

SEQ ID NO: 2727 - protein, 6 aa, Homo sapiens
  Light chain CDR3 for antibody 1364 (IGKV1-5)
QQYNSY

SEQ ID NO: 2728 - protein, 19 aa, Homo sapiens
  Heavy chain CDR3 for antibody 1364 (IGHV1-69)
ARGVRYCSGGSCYGAHFQH

SEQ ID NO: 2729 - protein, 9 aa, Homo sapiens
  Light chain CDR3 for antibody 1365 (IGKV1-5)
QQYNSYPWT

SEQ ID NO: 2730 - protein, 13 aa, Homo sapiens
  Heavy chain CDR3 for antibody 1365 (IGHV1-3)
ARGAVTNYDYFDY

SEQ ID NO: 2731 - protein, 9 aa, Homo sapiens
  Light chain CDR3 for antibody 1366 (IGKV1-9)
QQLNSYPPI

SEQ ID NO: 2732 - protein, 11 aa, Homo sapiens
  Heavy chain CDR3 for antibody 1366 (IGHV3-53)
ARDLGSSGSDY

SEQ ID NO: 2733 - protein, 7 aa, Homo sapiens
  Light chain CDR3 for antibody 1367 (IGKV3-20)
QQYGSSL

SEQ ID NO: 2734 - protein, 16 aa, Homo sapiens
  Heavy chain CDR3 for antibody 1367 (IGHV1-58)
AAPYCSGGSCFDAFDI

SEQ ID NO: 2735 - protein, 9 aa, Homo sapiens
  Light chain CDR3 for antibody 1368 (IGKV1-33)
QQYDNLPPT

SEQ ID NO: 2736 - protein, 20 aa, Homo sapiens
  Heavy chain CDR3 for antibody 1368 (IGHV3-NL1)
AKQVGEYCSGGSCYSYYFDY

SEQ ID NO: 2737 - protein, 9 aa, Homo sapiens
  Light chain CDR3 for antibody 1369 (IGKV3-20)
QQYGSSLWT

SEQ ID NO: 2738 - protein, 11 aa, Homo sapiens
  Heavy chain CDR3 for antibody 1369 (IGHV3-53)
ARGHWEYYFDY

SEQ ID NO: 2739 - protein, 8 aa, Homo sapiens
  Light chain CDR3 for antibody 1370 (IGKV1-39)
QQSYSMYT

SEQ ID NO: 2740 - protein, 12 aa, Homo sapiens
  Heavy chain CDR3 for antibody 1370 (IGHV3-53)
ARAPLGTDYFDS

SEQ ID NO: 2741 - protein, 10 aa, Homo sapiens
  Light chain CDR3 for antibody 1371 (IGKV1-9)
QQLNSYPGYT

SEQ ID NO: 2742 - protein, 11 aa, Homo sapiens
  Heavy chain CDR3 for antibody 1371 (IGHV3-53)
ARDRGGDVFDI

SEQ ID NO: 2743 - protein, 10 aa, Homo sapiens
  Light chain CDR3 for antibody 1372 (IGKV1-33)
QQYDNLPQYN

SEQ ID NO: 2744 - protein, 12 aa, Homo sapiens
  Heavy chain CDR3 for antibody 1372 (IGHV3-53)
AREIPSGSYWDY

SEQ ID NO: 2745 - protein, 10 aa, Homo sapiens
  Light chain CDR3 for antibody 1373 (IGKV1-39)
QQSYNTRALT

SEQ ID NO: 2746 - protein, 18 aa, Homo sapiens
  Heavy chain CDR3 for antibody 1373 (IGHV3-15)
TTDRGFRYQLLEHDAFDI

SEQ ID NO: 2747 - protein, 9 aa, Homo sapiens
  Light chain CDR3 for antibody 1374 (IGKV1-5)
QQYKSYSQT

SEQ ID NO: 2748 - protein, 16 aa, Homo sapiens
  Heavy chain CDR3 for antibody 1374 (IGHV3-30)
AKPLFTYSYGQNYFDY

SEQ ID NO: 2749 - protein, 10 aa, Homo sapiens
  Light chain CDR3 for antibody 1375 (IGKV1-39)
QQSYVTPGLT

SEQ ID NO: 2750 - protein, 13 aa, Homo sapiens
  Heavy chain CDR3 for antibody 1375 (IGHV3-64)
ARDADRAVPIFDY

SEQ ID NO: 2751 - protein, 9 aa, Homo sapiens
  Light chain CDR3 for antibody 1376 (IGKV1-39)
QQSYSTPQT

SEQ ID NO: 2752 - protein, 14 aa, Homo sapiens
  Heavy chain CDR3 for antibody 1376 (IGHV1-69)
AREVEMATLYGMDV

SEQ ID NO: 2753 - protein, 9 aa, Homo sapiens
  Light chain CDR3 for antibody 1377 (IGKV1-5)
QQYNSYPVT

SEQ ID NO: 2754 - protein, 21 aa, Homo sapiens
  Heavy chain CDR3 for antibody 1377 (IGHV4-b)
ARDGLTGGIVVVPAAQYYFDY

SEQ ID NO: 2755 - protein, 8 aa, Homo sapiens
  Light chain CDR3 for antibody 1378 (IGKV1-12)
QQANSFPL

SEQ ID NO: 2756 - protein, 11 aa, Homo sapiens
  Heavy chain CDR3 for antibody 1378 (IGHV3-53)
ARGHWEYYFDY

SEQ ID NO: 2757 - protein, 7 aa, Homo sapiens
  Light chain CDR3 for antibody 1379 (IGKV3-20)
QQYGSSL

SEQ ID NO: 2758 - protein, 11 aa, Homo sapiens
  Heavy chain CDR3 for antibody 1379 (IGHV3-53)
ARDRYSYGLDY

SEQ ID NO: 2759 - protein, 9 aa, Homo sapiens
  Light chain CDR3 for antibody 1380 (IGKV1-9)
QQLNSDPPP

SEQ ID NO: 2760 - protein, 11 aa, Homo sapiens
  Heavy chain CDR3 for antibody 1380 (IGHV3-53)
ARGHWEYYFDY

SEQ ID NO: 2761 - protein, 8 aa, Homo sapiens
  Light chain CDR3 for antibody 1381 (IGKV1-39)
QQSYSTPS

SEQ ID NO: 2762 - protein, 14 aa, Homo sapiens
  Heavy chain CDR3 for antibody 1381 (IGHV1-69)
AREVEMATLYGMDV

SEQ ID NO: 2763 - protein, 9 aa, Homo sapiens
  Light chain CDR3 for antibody 1382 (IGKV1-39)
QQSYSTPYT

SEQ ID NO: 2764 - protein, 12 aa, Homo sapiens
  Heavy chain CDR3 for antibody 1382 (IGHV3-53)
ARDLFEAGGMDV

SEQ ID NO: 2765 - protein, 12 aa, Homo sapiens
  Light chain CDR3 for antibody 1383 (IGKV1-9)
QQLNSYPQNGLT

SEQ ID NO: 2766 - protein, 11 aa, Homo sapiens
  Heavy chain CDR3 for antibody 1383 (IGHV3-53)
ARAYGDYYFDY

SEQ ID NO: 2767 - protein, 8 aa, Homo sapiens
  Light chain CDR3 for antibody 1384 (IGKV1-9)
QQLNSYPF

SEQ ID NO: 2768 - protein, 11 aa, Homo sapiens
  Heavy chain CDR3 for antibody 1384 (IGHV3-53)
ARDLDYYGMDV

SEQ ID NO: 2769 - protein, 9 aa, Homo sapiens
  Light chain CDR3 for antibody 1385 (IGKV1-5)
QHYNIYPYT

SEQ ID NO: 2770 - protein, 11 aa, Homo sapiens
  Heavy chain CDR3 for antibody 1385 (IGHV3-53)
ARGHWEYYFDY

SEQ ID NO: 2771 - protein, 9 aa, Homo sapiens
  Light chain CDR3 for antibody 1386 (IGKV2D-28)
MQALQTPHT

SEQ ID NO: 2772 - protein, 18 aa, Homo sapiens
  Heavy chain CDR3 for antibody 1386 (IGHV1-18)
ARDLVGYCSGGSCHSGDY

SEQ ID NO: 2773 - protein, 10 aa, Homo sapiens
  Light chain CDR3 for antibody 1387 (IGKV1-9)
QQLNSYPGGR

SEQ ID NO: 2774 - protein, 9 aa, Homo sapiens
  Heavy chain CDR3 for antibody 1387 (IGHV3-53)
AREGYGMDV

SEQ ID NO: 2775 - protein, 9 aa, Homo sapiens
  Light chain CDR3 for antibody 1388 (IGKV1-27)
QKYNSVSDT

SEQ ID NO: 2776 - protein, 11 aa, Homo sapiens
  Heavy chain CDR3 for antibody 1388 (IGHV3-53)
ARGHWEYYFDY

SEQ ID NO: 2777 - protein, 8 aa, Homo sapiens
  Light chain CDR3 for antibody 1389 (IGKV1-39)
QQTYSTPG

SEQ ID NO: 2778 - protein, 17 aa, Homo sapiens
  Heavy chain CDR3 for antibody 1389 (IGHV3-9)
AKDHRYDYSNYGCYFDY

SEQ ID NO: 2779 - protein, 10 aa, Homo sapiens
  Light chain CDR3 for antibody 1390 (IGKV1-39)
QQSYSTPGLT

SEQ ID NO: 2780 - protein, 15 aa, Homo sapiens
  Heavy chain CDR3 for antibody 1390 (IGHV3-13)
ARDRGGYYTGYAFDI

SEQ ID NO: 2781 - protein, 7 aa, Homo sapiens
  Light chain CDR3 for antibody 1391 (IGKV3-20)
QQYGSSL

SEQ ID NO: 2782 - protein, 12 aa, Homo sapiens
  Heavy chain CDR3 for antibody 1391 (IGHV3-53)
ARPTLSRGGMDV

SEQ ID NO: 2783 - protein, 7 aa, Homo sapiens
  Light chain CDR3 for antibody 1392 (IGKV3-20)
QQYGSSL

SEQ ID NO: 2784 - protein, 13 aa, Homo sapiens
  Heavy chain CDR3 for antibody 1392 (IGHV3-53)
ARDGYCRGGSCYH

SEQ ID NO: 2785 - protein, 9 aa, Homo sapiens
  Light chain CDR3 for antibody 1393 (IGKV1-33)
QQYDNLPGT

SEQ ID NO: 2786 - protein, 12 aa, Homo sapiens
  Heavy chain CDR3 for antibody 1393 (IGHV3-53)
ARDLFEAGGMDV

SEQ ID NO: 2787 - protein, 9 aa, Homo sapiens
  Light chain CDR3 for antibody 1394 (IGKV1-33)
QQYDNLPGT

SEQ ID NO: 2788 - protein, 17 aa, Homo sapiens
  Heavy chain CDR3 for antibody 1394 (IGHV5-51)
ARRQGRWYRGMFHYMDV

SEQ ID NO: 2789 - protein, 10 aa, Homo sapiens
  Light chain CDR3 for antibody 1395 (IGKV3-20)
QQYGSSPMYT

SEQ ID NO: 2790 - protein, 12 aa, Homo sapiens
  Heavy chain CDR3 for antibody 1395 (IGHV4-34)
ARGLWSLWYFDL

SEQ ID NO: 2791 - protein, 9 aa, Homo sapiens
  Light chain CDR3 for antibody 1396 (IGKV2D-28)
MQALQTPCT

SEQ ID NO: 2792 - protein, 20 aa, Homo sapiens
  Heavy chain CDR3 for antibody 1396 (IGHV1-69)
ARVGAPPYGLRDYYYYGMDV

SEQ ID NO: 2793 - protein, 7 aa, Homo sapiens
  Light chain CDR3 for antibody 1397 (IGKV3-20)
QQYGSSL

SEQ ID NO: 2794 - protein, 11 aa, Homo sapiens
  Heavy chain CDR3 for antibody 1397 (IGHV3-53)
ARDYGDFYFDY

SEQ ID NO: 2795 - protein, 7 aa, Homo sapiens
  Light chain CDR3 for antibody 1398 (IGKV3-20)
QQYGSSL

SEQ ID NO: 2796 - protein, 11 aa, Homo sapiens
  Heavy chain CDR3 for antibody 1398 (IGHV3-53)
ARDRGSGWYDY

SEQ ID NO: 2797 - protein, 9 aa, Homo sapiens
  Light chain CDR3 for antibody 1399 (IGKV1-12)
QQANSFPWT

SEQ ID NO: 2798 - protein, 25 aa, Homo sapiens
  Heavy chain CDR3 for antibody 1399 (IGHV3-11)
ARDTLRATGYCSGGSCYDTKRWFDP

SEQ ID NO: 2799 - protein, 10 aa, Homo sapiens
  Light chain CDR3 for antibody 1400 (IGKV1-39)
QQSYSTPLIT

SEQ ID NO: 2800 - protein, 17 aa, Homo sapiens
  Heavy chain CDR3 for antibody 1400 (IGHV1-69)
ARGLRTVVVTARYGMDV

SEQ ID NO: 2801 - protein, 10 aa, Homo sapiens
  Light chain CDR3 for antibody 1401 (IGKV1-33)
QQYDDLPPYT

SEQ ID NO: 2802 - protein, 18 aa, Homo sapiens
  Heavy chain CDR3 for antibody 1401 (IGHV2-26)
AHRMTTATCSGACGAFDM

SEQ ID NO: 2803 - protein, 9 aa, Homo sapiens
  Light chain CDR3 for antibody 1402 (IGKV1-39)
QQSYSTPLT

SEQ ID NO: 2804 - protein, 11 aa, Homo sapiens
  Heavy chain CDR3 for antibody 1402 (IGHV3-53)
ARGHWEYYFDY

SEQ ID NO: 2805 - protein, 8 aa, Homo sapiens
  Light chain CDR3 for antibody 1403 (IGKV1-39)
QQSYSTPS

SEQ ID NO: 2806 - protein, 12 aa, Homo sapiens
  Heavy chain CDR3 for antibody 1403 (IGHV1/OR15-9)
ARVEVGATFVDY

SEQ ID NO: 2807 - protein, 9 aa, Homo sapiens
  Light chain CDR3 for antibody 1404 (IGKV1-39)
QQSYSAPLT

SEQ ID NO: 2808 - protein, 14 aa, Homo sapiens
  Heavy chain CDR3 for antibody 1404 (IGHV4-59)
TRGHQETPYNWFDP

SEQ ID NO: 2809 - protein, 9 aa, Homo sapiens
  Light chain CDR3 for antibody 1405 (IGKV1-5)
QQYNSYPWT

SEQ ID NO: 2810 - protein, 14 aa, Homo sapiens
  Heavy chain CDR3 for antibody 1405 (IGHV1-3)
ARGLAAGTSDAFDI

SEQ ID NO: 2811 - protein, 9 aa, Homo sapiens
  Light chain CDR3 for antibody 1406 (IGKV1-9)
QQLNSYPLT

SEQ ID NO: 2812 - protein, 11 aa, Homo sapiens
  Heavy chain CDR3 for antibody 1406 (IGHV3-53)
ARGHWEYYFDY

SEQ ID NO: 2813 - protein, 10 aa, Homo sapiens
  Light chain CDR3 for antibody 1407 (IGKV1-9)
QQLNSYPGYT

SEQ ID NO: 2814 - protein, 11 aa, Homo sapiens
  Heavy chain CDR3 for antibody 1407 (IGHV3-53)
ARGHWEYYFDY

SEQ ID NO: 2815 - protein, 7 aa, Homo sapiens
  Light chain CDR3 for antibody 1408 (IGKV3-20)
QQYGSSL

SEQ ID NO: 2816 - protein, 9 aa, Homo sapiens
  Heavy chain CDR3 for antibody 1408 (IGHV3-53)
ARDAPENGD

SEQ ID NO: 2817 - protein, 10 aa, Homo sapiens
  Light chain CDR3 for antibody 1409 (IGKV3-11)
QQRSNWPAGT

SEQ ID NO: 2818 - protein, 11 aa, Homo sapiens
  Heavy chain CDR3 for antibody 1409 (IGHV3-53)
ARGHWEYYFDY

SEQ ID NO: 2819 - protein, 7 aa, Homo sapiens
  Light chain CDR3 for antibody 1410 (IGKV3-20)
QQYGSSL

SEQ ID NO: 2820 - protein, 13 aa, Homo sapiens
  Heavy chain CDR3 for antibody 1410 (IGHV3-23)
AKDSRGSTDYFDY

SEQ ID NO: 2821 - protein, 9 aa, Homo sapiens
  Light chain CDR3 for antibody 1411 (IGKV1-33)
QQYDNLPQT

SEQ ID NO: 2822 - protein, 16 aa, Homo sapiens
  Heavy chain CDR3 for antibody 1411 (IGHV1-58)
AAPYCSGGSCFDAFDI

SEQ ID NO: 2823 - protein, 11 aa, Homo sapiens
  Light chain CDR3 for antibody 1412 (IGKV1-13)
QHFNGYPRSIP

SEQ ID NO: 2824 - protein, 11 aa, Homo sapiens
  Heavy chain CDR3 for antibody 1412 (IGHV4-31)
AGRSLVDNAFS

SEQ ID NO: 2825 - protein, 10 aa, Homo sapiens
  Light chain CDR3 for antibody 1413 (IGKV1-9)
QQLNSYPGFT

SEQ ID NO: 2826 - protein, 11 aa, Homo sapiens
  Heavy chain CDR3 for antibody 1413 (IGHV3-53)
ARDQGNDAFDI

SEQ ID NO: 2827 - protein, 10 aa, Homo sapiens
  Light chain CDR3 for antibody 1414 (IGKV1-39)
QQSYSNGSGT

SEQ ID NO: 2828 - protein, 11 aa, Homo sapiens
  Heavy chain CDR3 for antibody 1414 (IGHV3-53)
ARGHWEYYFDY

SEQ ID NO: 2829 - protein, 9 aa, Homo sapiens
  Light chain CDR3 for antibody 1415 (IGKV1-33)
QQYDNLPLT

SEQ ID NO: 2830 - protein, 15 aa, Homo sapiens
  Heavy chain CDR3 for antibody 1415 (IGHV4/OR15-8)
ARGEGGQLWFYAFDI

SEQ ID NO: 2831 - protein, 9 aa, Homo sapiens
  Light chain CDR3 for antibody 1416 (IGKV1-39)
QQGYNTPRT

SEQ ID NO: 2832 - protein, 13 aa, Homo sapiens
  Heavy chain CDR3 for antibody 1416 (IGHV1-2)
ARGRGAARLGMDV

SEQ ID NO: 2833 - protein, 7 aa, Homo sapiens
  Light chain CDR3 for antibody 1417 (IGKV3-20)
QQYGSSL

SEQ ID NO: 2834 - protein, 12 aa, Homo sapiens
  Heavy chain CDR3 for antibody 1417 (IGHV3-53)
ARDLFEAGGMDV

SEQ ID NO: 2835 - protein, 9 aa, Homo sapiens
  Light chain CDR3 for antibody 1418 (IGKV1-5)
QQYNSYPWT

SEQ ID NO: 2836 - protein, 12 aa, Homo sapiens
  Heavy chain CDR3 for antibody 1418 (IGHV1-69)
ARGPVVLGAFDI

SEQ ID NO: 2837 - protein, 7 aa, Homo sapiens
  Light chain CDR3 for antibody 1419 (IGKV1-9)
QQLNSYS

SEQ ID NO: 2838 - protein, 11 aa, Homo sapiens
  Heavy chain CDR3 for antibody 1419 (IGHV3-53)
ARGHWEYYFDY

SEQ ID NO: 2839 - protein, 10 aa, Homo sapiens
  Light chain CDR3 for antibody 1420 (IGKV1-39)
QQSYSTPPWT

SEQ ID NO: 2840 - protein, 16 aa, Homo sapiens
  Heavy chain CDR3 for antibody 1420 (IGHV1-58)
AAPYCSGGSCFDAFDI

SEQ ID NO: 2841 - protein, 8 aa, Homo sapiens
  Light chain CDR3 for antibody 1421 (IGKV2-30)
MQASHWPS

SEQ ID NO: 2842 - protein, 11 aa, Homo sapiens
  Heavy chain CDR3 for antibody 1421 (IGHV3-48)
ARDDGFRSVDF

SEQ ID NO: 2843 - protein, 7 aa, Homo sapiens
  Light chain CDR3 for antibody 1422 (IGKV3-20)
QQYGSSL

SEQ ID NO: 2844 - protein, 15 aa, Homo sapiens
  Heavy chain CDR3 for antibody 1422 (IGHV1-69)
ARGQGPYSYYYYMDV

SEQ ID NO: 2845 - protein, 9 aa, Homo sapiens
  Light chain CDR3 for antibody 1423 (IGKV6-21)
HQSSSLPWT

SEQ ID NO: 2846 - protein, 14 aa, Homo sapiens
  Heavy chain CDR3 for antibody 1423 (IGHV4-31)
AREVGSGYSWYFDL

SEQ ID NO: 2847 - protein, 7 aa, Homo sapiens
  Light chain CDR3 for antibody 1424 (IGKV3-20)
QQYGSSL

SEQ ID NO: 2848 - protein, 16 aa, Homo sapiens
  Heavy chain CDR3 for antibody 1424 (IGHV3-64)
ARDSGDSPALVTWFDY

SEQ ID NO: 2849 - protein, 9 aa, Homo sapiens
  Light chain CDR3 for antibody 1425 (IGKV1-39)
QQSYSTPRT

SEQ ID NO: 2850 - protein, 17 aa, Homo sapiens
  Heavy chain CDR3 for antibody 1425 (IGHV4-34)
ARASSETYGGYSDAFDI

SEQ ID NO: 2851 - protein, 8 aa, Homo sapiens
  Light chain CDR3 for antibody 1426 (IGKV3-15)
QQYNNWGT

SEQ ID NO: 2852 - protein, 16 aa, Homo sapiens
  Heavy chain CDR3 for antibody 1426 (IGHV1-58)
AAPYCSGGSCFDAFDI

SEQ ID NO: 2853 - protein, 9 aa, Homo sapiens
  Light chain CDR3 for antibody 1427 (IGKV1-12)
QQAKTFPCT

SEQ ID NO: 2854 - protein, 15 aa, Homo sapiens
  Heavy chain CDR3 for antibody 1427 (IGHV4/OR15-8)
ARGEGGQLWFYAFDI

SEQ ID NO: 2855 - protein, 8 aa, Homo sapiens
  Light chain CDR3 for antibody 1428 (IGKV1-12)
QQANSFPL

SEQ ID NO: 2856 - protein, 11 aa, Homo sapiens
  Heavy chain CDR3 for antibody 1428 (IGHV3-53)
ARDRVVYGMDV

SEQ ID NO: 2857 - protein, 7 aa, Homo sapiens
  Light chain CDR3 for antibody 1429 (IGKV3-20)
QQYGSSL

SEQ ID NO: 2858 - protein, 14 aa, Homo sapiens
  Heavy chain CDR3 for antibody 1429 (IGHV1-69)
ARYGVSYGDYLPDY

SEQ ID NO: 2859 - protein, 9 aa, Homo sapiens
  Light chain CDR3 for antibody 1430 (IGKV1-9)
QQLNSYPPD

SEQ ID NO: 2860 - protein, 12 aa, Homo sapiens
  Heavy chain CDR3 for antibody 1430 (IGHV3-53)
ARDLTAIRGFDY

SEQ ID NO: 2861 - protein, 7 aa, Homo sapiens
  Light chain CDR3 for antibody 1431 (IGKV3-20)
QQYGSSL

SEQ ID NO: 2862 - protein, 13 aa, Homo sapiens
  Heavy chain CDR3 for antibody 1431 (IGHV5-51)
ARQLCGGDCAFDY

SEQ ID NO: 2863 - protein, 7 aa, Homo sapiens
  Light chain CDR3 for antibody 1432 (IGKV3-20)
QQYGSSL

SEQ ID NO: 2864 - protein, 14 aa, Homo sapiens
  Heavy chain CDR3 for antibody 1432 (IGHV3-53)
ARLFYGGNSAGVDY

SEQ ID NO: 2865 - protein, 8 aa, Homo sapiens
  Light chain CDR3 for antibody 1433 (IGKV3-15)
QQYNNWGT

SEQ ID NO: 2866 - protein, 11 aa, Homo sapiens
  Heavy chain CDR3 for antibody 1433 (IGHV3-53)
ARGHWEYYFDY

SEQ ID NO: 2867 - protein, 8 aa, Homo sapiens
  Light chain CDR3 for antibody 1434 (IGKV3-20)
QQYGSSYT

SEQ ID NO: 2868 - protein, 12 aa, Homo sapiens
  Heavy chain CDR3 for antibody 1434 (IGHV3-53)
ARDLSVAGAFDI

SEQ ID NO: 2869 - protein, 8 aa, Homo sapiens
  Light chain CDR3 for antibody 1435 (IGKV1-12)
QQANSFPL

SEQ ID NO: 2870 - protein, 13 aa, Homo sapiens
  Heavy chain CDR3 for antibody 1435 (IGHV3-53)
ARDGYCRGGSCYH

SEQ ID NO: 2871 - protein, 10 aa, Homo sapiens
  Light chain CDR3 for antibody 1436 (IGKV3-11)
QQRSTWPPLT

SEQ ID NO: 2872 - protein, 11 aa, Homo sapiens
  Heavy chain CDR3 for antibody 1436 (IGHV3-21)
ARQTGYIYFDF

SEQ ID NO: 2873 - protein, 7 aa, Homo sapiens
  Light chain CDR3 for antibody 1437 (IGKV3-20)
QQYGSSL

SEQ ID NO: 2874 - protein, 11 aa, Homo sapiens
  Heavy chain CDR3 for antibody 1437 (IGHV3-21)
AREVSVTDFDY

SEQ ID NO: 2875 - protein, 9 aa, Homo sapiens
  Light chain CDR3 for antibody 1438 (IGKV1-39)
QQTYDTPWT

SEQ ID NO: 2876 - protein, 12 aa, Homo sapiens
  Heavy chain CDR3 for antibody 1438 (IGHV4-4)
ARDATSGLGHDY

SEQ ID NO: 2877 - protein, 10 aa, Homo sapiens
  Light chain CDR3 for antibody 1439 (IGKV1-39)
QQSYSTPPWT

SEQ ID NO: 2878 - protein, 19 aa, Homo sapiens
  Heavy chain CDR3 for antibody 1439 (IGHV3-13)
ARADHYYGSGRAWYYYMDV

SEQ ID NO: 2879 - protein, 9 aa, Homo sapiens
  Light chain CDR3 for antibody 1440 (IGKV1-39)
QQSYITLYS

SEQ ID NO: 2880 - protein, 10 aa, Homo sapiens
  Heavy chain CDR3 for antibody 1440 (IGHV1-2)
ARDPSGPLDF

SEQ ID NO: 2881 - protein, 9 aa, Homo sapiens
  Light chain CDR3 for antibody 1441 (IGKV2D-28)
MQALQTLYT

SEQ ID NO: 2882 - protein, 15 aa, Homo sapiens
  Heavy chain CDR3 for antibody 1441 (IGHV1-69)
AREDGDYGGLRAFDI

SEQ ID NO: 2883 - protein, 9 aa, Homo sapiens
  Light chain CDR3 for antibody 1442 (IGKV1-33)
QQYDNLPLT

SEQ ID NO: 2884 - protein, 18 aa, Homo sapiens
  Heavy chain CDR3 for antibody 1442 (IGHV3-11)
ARDEDPVYCANDVCTLDY

SEQ ID NO: 2885 - protein, 9 aa, Homo sapiens
  Light chain CDR3 for antibody 1443 (IGKV1-33)
QQYDNLPRT

SEQ ID NO: 2886 - protein, 11 aa, Homo sapiens
  Heavy chain CDR3 for antibody 1443 (IGHV3-53)
ARDLAVYGMDV

SEQ ID NO: 2887 - protein, 8 aa, Homo sapiens
  Light chain CDR3 for antibody 1444 (IGKV3-15)
QQYNNWSS

SEQ ID NO: 2888 - protein, 16 aa, Homo sapiens
  Heavy chain CDR3 for antibody 1444 (IGHV1-69)
ARPLRYHVSYYYYMDV

SEQ ID NO: 2889 - protein, 9 aa, Homo sapiens
  Light chain CDR3 for antibody 1445 (IGKV1-9)
QQLNSYPFT

SEQ ID NO: 2890 - protein, 12 aa, Homo sapiens
  Heavy chain CDR3 for antibody 1445 (IGHV1/OR15-9)
ARVEVGATFVDY

SEQ ID NO: 2891 - protein, 9 aa, Homo sapiens
  Light chain CDR3 for antibody 1446 (IGKV1-33)
QQYADLFPT

SEQ ID NO: 2892 - protein, 18 aa, Homo sapiens
  Heavy chain CDR3 for antibody 1446 (IGHV3-11)
ARECGSGESDCSSTSLAD

SEQ ID NO: 2893 - protein, 7 aa, Homo sapiens
  Light chain CDR3 for antibody 1447 (IGKV3-20)
QQYGSSL

SEQ ID NO: 2894 - protein, 11 aa, Homo sapiens
  Heavy chain CDR3 for antibody 1447 (IGHV3-53)
ARDLDYYGMDV

SEQ ID NO: 2895 - protein, 9 aa, Homo sapiens
  Light chain CDR3 for antibody 1448 (IGKV3-20)
QQYGSSLWT

SEQ ID NO: 2896 - protein, 15 aa, Homo sapiens
  Heavy chain CDR3 for antibody 1448 (IGHV1-69)
ARGQGPYSYYYYMDV

SEQ ID NO: 2897 - protein, 9 aa, Homo sapiens
  Light chain CDR3 for antibody 1449 (IGKV1-9)
QQLNSDPPP

SEQ ID NO: 2898 - protein, 13 aa, Homo sapiens
  Heavy chain CDR3 for antibody 1449 (IGHV3-53)
ARDGYCRGGSCYH

SEQ ID NO: 2899 - protein, 7 aa, Homo sapiens
  Light chain CDR3 for antibody 1450 (IGKV3-20)
QQYGSSL

SEQ ID NO: 2900 - protein, 17 aa, Homo sapiens
  Heavy chain CDR3 for antibody 1450 (IGHV1-69)
ARGPPLPSSGWSEIWVY

SEQ ID NO: 2901 - protein, 9 aa, Homo sapiens
  Light chain CDR3 for antibody 1451 (IGKV1-5)
QQYNSYSRT

SEQ ID NO: 2902 - protein, 11 aa, Homo sapiens
  Heavy chain CDR3 for antibody 1451 (IGHV3-53)
ARGHWEYYFDY

SEQ ID NO: 2903 - protein, 9 aa, Homo sapiens
  Light chain CDR3 for antibody 1452 (IGKV1-33)
QQYDNLPRT

SEQ ID NO: 2904 - protein, 11 aa, Homo sapiens
  Heavy chain CDR3 for antibody 1452 (IGHV3-53)
ARDRGSGWYDY

SEQ ID NO: 2905 - protein, 9 aa, Homo sapiens
  Light chain CDR3 for antibody 1453 (IGKV1-39)
QQNLVIPRA

SEQ ID NO: 2906 - protein, 11 aa, Homo sapiens
  Heavy chain CDR3 for antibody 1453 (IGHV3-53)
ARGHWEYYFDY

SEQ ID NO: 2907 - protein, 8 aa, Homo sapiens
  Light chain CDR3 for antibody 1454 (IGKV1-12)
QQANSFPL

SEQ ID NO: 2908 - protein, 16 aa, Homo sapiens
  Heavy chain CDR3 for antibody 1454 (IGHV1-58)
AAPYCSGGSCFDAFDI

SEQ ID NO: 2909 - protein, 9 aa, Homo sapiens
  Light chain CDR3 for antibody 1455 (IGKV1-39)
QQSYSTPRT

SEQ ID NO: 2910 - protein, 15 aa, Homo sapiens
  Heavy chain CDR3 for antibody 1455 (IGHV2-70)
ARMEYGSGSYLAFDI

SEQ ID NO: 2911 - protein, 9 aa, Homo sapiens
  Light chain CDR3 for antibody 1456 (IGKV1-12)
QQANSFPLG

SEQ ID NO: 2912 - protein, 22 aa, Homo sapiens
  Heavy chain CDR3 for antibody 1456 (IGHV1-69)
ARGAAGYYDSFGALILQYYMDV

SEQ ID NO: 2913 - protein, 10 aa, Homo sapiens
  Light chain CDR3 for antibody 1457 (IGKV1-33)
QQYDNLPRYT

SEQ ID NO: 2914 - protein, 11 aa, Homo sapiens
  Heavy chain CDR3 for antibody 1457 (IGHV3-53)
ARGHWEYYFDY

SEQ ID NO: 2915 - protein, 9 aa, Homo sapiens
  Light chain CDR3 for antibody 1458 (IGKV1-33)
QQYDNLPLT

SEQ ID NO: 2916 - protein, 14 aa, Homo sapiens
  Heavy chain CDR3 for antibody 1458 (IGHV3-23)
ATPRGSGWYEPFDY

SEQ ID NO: 2917 - protein, 9 aa, Homo sapiens
  Light chain CDR3 for antibody 1459 (IGKV4-1)
QQYYSPPQT

SEQ ID NO: 2918 - protein, 14 aa, Homo sapiens
  Heavy chain CDR3 for antibody 1459 (IGHV3-h)
ARRGDHDYGEISDY

SEQ ID NO: 2919 - protein, 7 aa, Homo sapiens
  Light chain CDR3 for antibody 1460 (IGKV3-20)
QQYGSSL

SEQ ID NO: 2920 - protein, 19 aa, Homo sapiens
  Heavy chain CDR3 for antibody 1460 (IGHV1-3)
ATGLGKHDYSNYVVDYMDV

SEQ ID NO: 2921 - protein, 8 aa, Homo sapiens
  Light chain CDR3 for antibody 1461 (IGKV1-39)
QQSYSMYT

SEQ ID NO: 2922 - protein, 11 aa, Homo sapiens
  Heavy chain CDR3 for antibody 1461 (IGHV3-53)
ARGHWEYYFDY

SEQ ID NO: 2923 - protein, 9 aa, Homo sapiens
  Light chain CDR3 for antibody 1462 (IGKV3-20)
QQYGSSPGT

SEQ ID NO: 2924 - protein, 15 aa, Homo sapiens
  Heavy chain CDR3 for antibody 1462 (IGHV4-4)
ARVGGSYFGYYGMDV

SEQ ID NO: 2925 - protein, 9 aa, Homo sapiens
  Light chain CDR3 for antibody 1463 (IGKV3-20)
QQYGSSLWT

SEQ ID NO: 2926 - protein, 13 aa, Homo sapiens
  Heavy chain CDR3 for antibody 1463 (IGHV5-51)
ARQLCGGDCAFDY

SEQ ID NO: 2927 - protein, 9 aa, Homo sapiens
  Light chain CDR3 for antibody 1464 (IGKV3-20)
HQYAGAPLT

SEQ ID NO: 2928 - protein, 10 aa, Homo sapiens
  Heavy chain CDR3 for antibody 1464 (IGHV2-5)
AHSSGWLYDF

SEQ ID NO: 2929 - protein, 9 aa, Homo sapiens
  Light chain CDR3 for antibody 1465 (IGKV1-39)
QQSYITLYS

SEQ ID NO: 2930 - protein, 11 aa, Homo sapiens
  Heavy chain CDR3 for antibody 1465 (IGHV1-2)
AREYTSGKSDP

SEQ ID NO: 2931 - protein, 7 aa, Homo sapiens
  Light chain CDR3 for antibody 1466 (IGKV3-20)
QQYGSSL

SEQ ID NO: 2932 - protein, 12 aa, Homo sapiens
  Heavy chain CDR3 for antibody 1466 (IGHV3-53)
AREIPSGSYWDY

SEQ ID NO: 2933 - protein, 7 aa, Homo sapiens
  Light chain CDR3 for antibody 1467 (IGKV3-20)
QQYGSSL

SEQ ID NO: 2934 - protein, 13 aa, Homo sapiens
  Heavy chain CDR3 for antibody 1467 (IGHV1-3)
ARGAVTNYDYFDY

SEQ ID NO: 2935 - protein, 8 aa, Homo sapiens
  Light chain CDR3 for antibody 1468 (IGKV1-12)
QQANSFPL

SEQ ID NO: 2936 - protein, 12 aa, Homo sapiens
  Heavy chain CDR3 for antibody 1468 (IGHV3-53)
ARPTLSRGGMDV

SEQ ID NO: 2937 - protein, 9 aa, Homo sapiens
  Light chain CDR3 for antibody 1469 (IGKV1-39)
QQSYSTPLS

SEQ ID NO: 2938 - protein, 16 aa, Homo sapiens
  Heavy chain CDR3 for antibody 1469 (IGHV1-69)
ARPLRYHVSYYYYMDV

SEQ ID NO: 2939 - protein, 7 aa, Homo sapiens
  Light chain CDR3 for antibody 1470 (IGKV3-20)
QQYGSSL

SEQ ID NO: 2940 - protein, 11 aa, Homo sapiens
  Heavy chain CDR3 for antibody 1470 (IGHV3-53)
ARDLGSSGSDY

SEQ ID NO: 2941 - protein, 8 aa, Homo sapiens
  Light chain CDR3 for antibody 1471 (IGKV4-1)
QQYYSTPS

SEQ ID NO: 2942 - protein, 11 aa, Homo sapiens
  Heavy chain CDR3 for antibody 1471 (IGHV3-53)
ARGHWEYYFDY

SEQ ID NO: 2943 - protein, 9 aa, Homo sapiens
  Light chain CDR3 for antibody 1472 (IGKV1-5)
QQYNSYPRT

SEQ ID NO: 2944 - protein, 15 aa, Homo sapiens
  Heavy chain CDR3 for antibody 1472 (IGHV3-11)
ARGQGPYSYYYYMDV

SEQ ID NO: 2945 - protein, 9 aa, Homo sapiens
  Light chain CDR3 for antibody 1473 (IGKV1-33)
QQYDNLPRT

SEQ ID NO: 2946 - protein, 11 aa, Homo sapiens
  Heavy chain CDR3 for antibody 1473 (IGHV3-53)
ARDYGDFYFDY

SEQ ID NO: 2947 - protein, 9 aa, Homo sapiens
  Light chain CDR3 for antibody 1474 (IGKV1-33)
QQYDNLPRT

SEQ ID NO: 2948 - protein, 17 aa, Homo sapiens
  Heavy chain CDR3 for antibody 1474 (IGHV1-69)
ARGPPLPSSGWSEIWVY

SEQ ID NO: 2949 - protein, 7 aa, Homo sapiens
  Light chain CDR3 for antibody 1475 (IGKV3-20)
QQYGSSL

SEQ ID NO: 2950 - protein, 14 aa, Homo sapiens
  Heavy chain CDR3 for antibody 1475 (IGHV4-39)
ASGDYGDYHRGFDY

SEQ ID NO: 2951 - protein, 9 aa, Homo sapiens
  Light chain CDR3 for antibody 1476 (IGKV1-9)
QQLNSDPPP

SEQ ID NO: 2952 - protein, 16 aa, Homo sapiens
  Heavy chain CDR3 for antibody 1476 (IGHV1-58)
AAPYCSGGSCFDAFDI

SEQ ID NO: 2953 - protein, 7 aa, Homo sapiens
  Light chain CDR3 for antibody 1477 (IGKV3-20)
QQYGSSL

SEQ ID NO: 2954 - protein, 16 aa, Homo sapiens
  Heavy chain CDR3 for antibody 1477 (IGHV3-30)
AKPLFTYSYGQNYFDY

SEQ ID NO: 2955 - protein, 7 aa, Homo sapiens
  Light chain CDR3 for antibody 1478 (IGKV3-20)
QQYGSSL

SEQ ID NO: 2956 - protein, 12 aa, Homo sapiens
  Heavy chain CDR3 for antibody 1478 (IGHV3-53)
ARAPLGTDYFDS

SEQ ID NO: 2957 - protein, 9 aa, Homo sapiens
  Light chain CDR3 for antibody 1479 (IGKV1-5)
QEYNRYSYT

SEQ ID NO: 2958 - protein, 16 aa, Homo sapiens
  Heavy chain CDR3 for antibody 1479 (IGHV4-59)
ARDGDGSGIGLYGMNV

SEQ ID NO: 2959 - protein, 10 aa, Homo sapiens
  Light chain CDR3 for antibody 1480 (IGKV3-15)
QQYYHWPPIT

SEQ ID NO: 2960 - protein, 18 aa, Homo sapiens
  Heavy chain CDR3 for antibody 1480 (IGHV4-39)
RSDCSATSCPYDSYGVDV

SEQ ID NO: 2961 - protein, 9 aa, Homo sapiens
  Light chain CDR3 for antibody 1481 (IGKV1-27)
LQHNSYPLT

SEQ ID NO: 2962 - protein, 15 aa, Homo sapiens
  Heavy chain CDR3 for antibody 1481 (IGHV1-69)
ARENPYDSSGWYSDY

SEQ ID NO: 2963 - protein, 9 aa, Homo sapiens
  Light chain CDR3 for antibody 1482 (IGKV1-39)
QQSYSTPRT

SEQ ID NO: 2964 - protein, 14 aa, Homo sapiens
  Heavy chain CDR3 for antibody 1482 (IGHV1-18)
ARDGYGDSLADFDY

SEQ ID NO: 2965 - protein, 9 aa, Homo sapiens
  Light chain CDR3 for antibody 1483 (IGKV1-17)
LQHSSYPWA

SEQ ID NO: 2966 - protein, 21 aa, Homo sapiens
  Heavy chain CDR3 for antibody 1483 (IGHV1-24)
AVRPALYRTFSGYKYGDPFDH

SEQ ID NO: 2967 - protein, 9 aa, Homo sapiens
  Light chain CDR3 for antibody 1484 (IGKV1-5)
QHYNIYPYT

SEQ ID NO: 2968 - protein, 11 aa, Homo sapiens
  Heavy chain CDR3 for antibody 1484 (IGHV3-53)
ARDRVVYGMDV

SEQ ID NO: 2969 - protein, 8 aa, Homo sapiens
  Light chain CDR3 for antibody 1485 (IGKV1-5)
QQYSAHIT

SEQ ID NO: 2970 - protein, 17 aa, Homo sapiens
  Heavy chain CDR3 for antibody 1485 (IGHV5-51)
ARRQGRWYRGMFHYMDV

SEQ ID NO: 2971 - protein, 10 aa, Homo sapiens
  Light chain CDR3 for antibody 1486 (IGKV3-11)
QQRSNWPAGT

SEQ ID NO: 2972 - protein, 16 aa, Homo sapiens
  Heavy chain CDR3 for antibody 1486 (IGHV1-58)
AAPYCSGGSCFDAFDI

SEQ ID NO: 2973 - protein, 8 aa, Homo sapiens
  Light chain CDR3 for antibody 1487 (IGKV1-5)
QQYNSYSA

SEQ ID NO: 2974 - protein, 16 aa, Homo sapiens
  Heavy chain CDR3 for antibody 1487 (IGHV1-69)
AAPYCSGGSCFDAFDI

SEQ ID NO: 2975 - protein, 9 aa, Homo sapiens
  Light chain CDR3 for antibody 1488 (IGKV1-9)
QQLNSDPPP

SEQ ID NO: 2976 - protein, 12 aa, Homo sapiens
  Heavy chain CDR3 for antibody 1488 (IGHV3-53)
ARPTLSRGGMDV

SEQ ID NO: 2977 - protein, 9 aa, Homo sapiens
  Light chain CDR3 for antibody 1489 (IGKV1-27)
QKYNSVSDT

SEQ ID NO: 2978 - protein, 11 aa, Homo sapiens
  Heavy chain CDR3 for antibody 1489 (IGHV3-53)
ARDRYSYGLDY

SEQ ID NO: 2979 - protein, 7 aa, Homo sapiens
  Light chain CDR3 for antibody 1490 (IGKV3-20)
QQYGSSL

SEQ ID NO: 2980 - protein, 11 aa, Homo sapiens
  Heavy chain CDR3 for antibody 1490 (IGHV3-53)
ARDRGGDVFDI

SEQ ID NO: 2981 - protein, 10 aa, Homo sapiens
  Light chain CDR3 for antibody 1491 (IGKV1-39)
QQNYDTLALT

SEQ ID NO: 2982 - protein, 18 aa, Homo sapiens
  Heavy chain CDR3 for antibody 1491 (IGHV1-2)
AREPRYNNHDDAAGAFDI

SEQ ID NO: 2983 - protein, 10 aa, Homo sapiens
  Light chain CDR3 for antibody 1492 (IGKV1-12)
QQANSFRSWT

SEQ ID NO: 2984 - protein, 14 aa, Homo sapiens
  Heavy chain CDR3 for antibody 1492 (IGHV1-18)
AQTRYITGGYYFDS

SEQ ID NO: 2985 - protein, 9 aa, Homo sapiens
  Light chain CDR3 for antibody 1493 (IGKV1-9)
QQLNSDPPP

SEQ ID NO: 2986 - protein, 13 aa, Homo sapiens
  Heavy chain CDR3 for antibody 1493 (IGHV5-51)
ARQLCGGDCAFDY

SEQ ID NO: 2987 - protein, 8 aa, Homo sapiens
  Light chain CDR3 for antibody 1494 (IGKV1-5)
QQYNSYSA

SEQ ID NO: 2988 - protein, 11 aa, Homo sapiens
  Heavy chain CDR3 for antibody 1494 (IGHV3-53)
ARGHWEYYFDY

SEQ ID NO: 2989 - protein, 10 aa, Homo sapiens
  Light chain CDR3 for antibody 1495 (IGKV3-20)
QQYGSSPPWT

SEQ ID NO: 2990 - protein, 11 aa, Homo sapiens
  Heavy chain CDR3 for antibody 1495 (IGHV3-53)
ARGHWEYYFDY

SEQ ID NO: 2991 - protein, 9 aa, Homo sapiens
  Light chain CDR3 for antibody 1496 (IGKV1-33)
QQYDNLPRT

SEQ ID NO: 2992 - protein, 14 aa, Homo sapiens
  Heavy chain CDR3 for antibody 1496 (IGHV1-69)
AREVEMATLYGMDV

SEQ ID NO: 2993 - protein, 9 aa, Homo sapiens
  Light chain CDR3 for antibody 1497 (IGKV1-27)
QKYNSVSDT

SEQ ID NO: 2994 - protein, 16 aa, Homo sapiens
  Heavy chain CDR3 for antibody 1497 (IGHV1-58)
AAPYCSGGSCFDAFDI

SEQ ID NO: 2995 - protein, 9 aa, Homo sapiens
  Light chain CDR3 for antibody 1498 (IGKV1-27)
QKYNSAPWT

SEQ ID NO: 2996 - protein, 18 aa, Homo sapiens
  Heavy chain CDR3 for antibody 1498 (IGHV3-73)
TTHYGSGRPDYYYYYMDV

SEQ ID NO: 2997 - protein, 9 aa, Homo sapiens
  Light chain CDR3 for antibody 1499 (IGKV1-9)
QQLNSDPPP

SEQ ID NO: 2998 - protein, 11 aa, Homo sapiens
  Heavy chain CDR3 for antibody 1499 (IGHV3-53)
ARDRYSYGLDY

SEQ ID NO: 2999 - protein, 9 aa, Homo sapiens
  Light chain CDR3 for antibody 1500 (IGKV1-39)
QQSYSTPRT

SEQ ID NO: 3000 - protein, 16 aa, Homo sapiens
  Heavy chain CDR3 for antibody 1500 (IGHV1-69)
ARESWYSSSRLSWFDP

SEQ ID NO: 3001 - protein, 7 aa, Homo sapiens
  Light chain CDR3 for antibody 1501 (IGKV3-20)
QQYGSSL

SEQ ID NO: 3002 - protein, 14 aa, Homo sapiens
  Heavy chain CDR3 for antibody 1501 (IGHV1-69)
AREVEMATLYGMDV

SEQ ID NO: 3003 - protein, 10 aa, Homo sapiens
  Light chain CDR3 for antibody 1502 (IGKV1-39)
QQSYTTFMYT

SEQ ID NO: 3004 - protein, 14 aa, Homo sapiens
  Heavy chain CDR3 for antibody 1502 (IGHV3-64)
AREEGQWLVLYFRY

SEQ ID NO: 3005 - protein, 9 aa, Homo sapiens
  Light chain CDR3 for antibody 1503 (IGKV1-33)
QQYDNLPQT

SEQ ID NO: 3006 - protein, 11 aa, Homo sapiens
  Heavy chain CDR3 for antibody 1503 (IGHV3-53)
ARDRVVYGMDV

SEQ ID NO: 3007 - protein, 9 aa, Homo sapiens
  Light chain CDR3 for antibody 1504 (IGKV1-33)
QQYDNLPRT

SEQ ID NO: 3008 - protein, 12 aa, Homo sapiens
  Heavy chain CDR3 for antibody 1504 (IGHV3-53)
AREIPSGSYWDY

SEQ ID NO: 3009 - protein, 7 aa, Homo sapiens
  Light chain CDR3 for antibody 1505 (IGKV3-20)
QQYGSSL

SEQ ID NO: 3010 - protein, 21 aa, Homo sapiens
  Heavy chain CDR3 for antibody 1505 (IGHV2-5)
AQRLGYCSSTSCYNRFVAFDI

SEQ ID NO: 3011 - protein, 9 aa, Homo sapiens
  Light chain CDR3 for antibody 1506 (IGKV3-20)
QQYGSSLWT

SEQ ID NO: 3012 - protein, 11 aa, Homo sapiens
  Heavy chain CDR3 for antibody 1506 (IGHV3-53)
ARDLDYYGMDV

SEQ ID NO: 3013 - protein, 8 aa, Homo sapiens
  Light chain CDR3 for antibody 1507 (IGKV1-12)
QQANSFPL

SEQ ID NO: 3014 - protein, 11 aa, Homo sapiens
  Heavy chain CDR3 for antibody 1507 (IGHV3-53)
ARDRGSGWYDY

SEQ ID NO: 3015 - protein, 9 aa, Homo sapiens
  Light chain CDR3 for antibody 1508 (IGKV1-9)
QQLNSYPLT

SEQ ID NO: 3016 - protein, 11 aa, Homo sapiens
  Heavy chain CDR3 for antibody 1508 (IGHV3-53)
ARDRYSYGLDY

SEQ ID NO: 3017 - protein, 7 aa, Homo sapiens
  Light chain CDR3 for antibody 1509 (IGKV3-20)
QQYGSSL

SEQ ID NO: 3018 - protein, 18 aa, Homo sapiens
  Heavy chain CDR3 for antibody 1509 (IGHV4/OR15-8)
ARVSPFEGALRFSLGFDP

SEQ ID NO: 3019 - protein, 7 aa, Homo sapiens
  Light chain CDR3 for antibody 1510 (IGKV3-20)
QQYGSSL

SEQ ID NO: 3020 - protein, 12 aa, Homo sapiens
  Heavy chain CDR3 for antibody 1510 (IGHV3-15)
TTDSRTLYALDV

SEQ ID NO: 3021 - protein, 10 aa, Homo sapiens
  Light chain CDR3 for antibody 1511 (IGKV3-11)
QQRSNWPAGT

SEQ ID NO: 3022 - protein, 15 aa, Homo sapiens
  Heavy chain CDR3 for antibody 1511 (IGHV1-69)
ARGQGPYSYYYYMDV

SEQ ID NO: 3023 - protein, 10 aa, Homo sapiens
  Light chain CDR3 for antibody 1512 (IGKV1-39)
QQSYSNGSGT

SEQ ID NO: 3024 - protein, 11 aa, Homo sapiens
  Heavy chain CDR3 for antibody 1512 (IGHV3-53)
ARDRVVYGMDV

SEQ ID NO: 3025 - protein, 8 aa, Homo sapiens
  Light chain CDR3 for antibody 1513 (IGKV3-20)
QQYGSSYT

SEQ ID NO: 3026 - protein, 11 aa, Homo sapiens
  Heavy chain CDR3 for antibody 1513 (IGHV3-53)
ARGHWEYYFDY

SEQ ID NO: 3027 - protein, 9 aa, Homo sapiens
  Light chain CDR3 for antibody 1514 (IGKV1-33)
QQYDNLPRT

SEQ ID NO: 3028 - protein, 19 aa, Homo sapiens
  Heavy chain CDR3 for antibody 1514 (IGHV3-53)
ARGVRYCSGGSCYGAHFQH

SEQ ID NO: 3029 - protein, 9 aa, Homo sapiens
  Light chain CDR3 for antibody 1515 (IGKV1-27)
QKYNSVSDT

SEQ ID NO: 3030 - protein, 13 aa, Homo sapiens
  Heavy chain CDR3 for antibody 1515 (IGHV3-53)
ARDGYCRGGSCYH

SEQ ID NO: 3031 - protein, 12 aa, Homo sapiens
  Light chain CDR3 for antibody 1516 (IGKV1-9)
QQLNSYPQNGLT

SEQ ID NO: 3032 - protein, 11 aa, Homo sapiens
  Heavy chain CDR3 for antibody 1516 (IGHV3-53)
ARGHWEYYFDY

SEQ ID NO: 3033 - protein, 7 aa, Homo sapiens
  Light chain CDR3 for antibody 1517 (IGKV3-20)
QQYGSSL

SEQ ID NO: 3034 - protein, 9 aa, Homo sapiens
  Heavy chain CDR3 for antibody 1517 (IGHV3-53)
AREGYGMDV

SEQ ID NO: 3035 - protein, 10 aa, Homo sapiens
  Light chain CDR3 for antibody 1518 (IGKV1-39)
QQSYSTPPWT

SEQ ID NO: 3036 - protein, 11 aa, Homo sapiens
  Heavy chain CDR3 for antibody 1518 (IGHV3-53)
ARDRGSGWYDY

SEQ ID NO: 3037 - protein, 9 aa, Homo sapiens
  Light chain CDR3 for antibody 1519 (IGKV1-12)
QQANSFPPT

SEQ ID NO: 3038 - protein, 11 aa, Homo sapiens
  Heavy chain CDR3 for antibody 1519 (IGHV3-53)
ARGHWEYYFDY

SEQ ID NO: 3039 - protein, 8 aa, Homo sapiens
  Light chain CDR3 for antibody 1520 (IGKV1-12)
QQANSFPL

SEQ ID NO: 3040 - protein, 9 aa, Homo sapiens
  Heavy chain CDR3 for antibody 1520 (IGHV3-53)
ARDAPENGD

SEQ ID NO: 3041 - protein, 9 aa, Homo sapiens
  Light chain CDR3 for antibody 1521 (IGKV1-9)
QQLNSYPLT

SEQ ID NO: 3042 - protein, 13 aa, Homo sapiens
  Heavy chain CDR3 for antibody 1521 (IGHV3-53)
ARDGYCRGGSCNH

SEQ ID NO: 3043 - protein, 8 aa, Homo sapiens
  Light chain CDR3 for antibody 1522 (IGKV1-5)
QQYNSYSA

SEQ ID NO: 3044 - protein, 15 aa, Homo sapiens
  Heavy chain CDR3 for antibody 1522 (IGHV1-69)
ARGQGPYSYYYYMDV

SEQ ID NO: 3045 - protein, 7 aa, Homo sapiens
  Light chain CDR3 for antibody 1523 (IGKV3-20)
QQYGSSL

SEQ ID NO: 3046 - protein, 19 aa, Homo sapiens
  Heavy chain CDR3 for antibody 1523 (IGHV1-69)
AEGRALTLSYSSSYGAFDY

SEQ ID NO: 3047 - protein, 9 aa, Homo sapiens
  Light chain CDR3 for antibody 1524 (IGKV3-20)
QQYGSSPRT

SEQ ID NO: 3048 - protein, 9 aa, Homo sapiens
  Heavy chain CDR3 for antibody 1524 (IGHV3-53)
ARDAPENGD

SEQ ID NO: 3049 - protein, 9 aa, Homo sapiens
  Light chain CDR3 for antibody 1525 (IGKV3-20)
QQYGSSLWT

SEQ ID NO: 3050 - protein, 19 aa, Homo sapiens
  Heavy chain CDR3 for antibody 1525 (IGHV1-3)
ATGLGKHDYSNYVVDYMDV

SEQ ID NO: 3051 - protein, 9 aa, Homo sapiens
  Light chain CDR3 for antibody 1526 (IGKV2D-28)
MQALQTPHT

SEQ ID NO: 3052 - protein, 16 aa, Homo sapiens
  Heavy chain CDR3 for antibody 1526 (IGHV1-58)
AAPYCSGGSCFDAFDI

SEQ ID NO: 3053 - protein, 9 aa, Homo sapiens
  Light chain CDR3 for antibody 1527 (IGKV3-20)
QQYGSSLWT

SEQ ID NO: 3054 - protein, 11 aa, Homo sapiens
  Heavy chain CDR3 for antibody 1527 (IGHV1-58)
ARDRYSYGLDY

SEQ ID NO: 3055 - protein, 7 aa, Homo sapiens
  Light chain CDR3 for antibody 1528 (IGKV3-20)
QQYGSSL

SEQ ID NO: 3056 - protein, 11 aa, Homo sapiens
  Heavy chain CDR3 for antibody 1528 (IGHV3-53)
ARGDWEWCFDY

SEQ ID NO: 3057 - protein, 9 aa, Homo sapiens
  Light chain CDR3 for antibody 1529 (IGKV1-39)
QQSYTTPWT

SEQ ID NO: 3058 - protein, 14 aa, Homo sapiens
  Heavy chain CDR3 for antibody 1529 (IGHV1-2)
ARDVARNNSAWIDY

SEQ ID NO: 3059 - protein, 10 aa, Homo sapiens
  Light chain CDR3 for antibody 1530 (IGKV1-39)
QQSYSTPPWT

SEQ ID NO: 3060 - protein, 11 aa, Homo sapiens
  Heavy chain CDR3 for antibody 1530 (IGHV3-33)
ARDRVVYGMDV

SEQ ID NO: 3061 - protein, 9 aa, Homo sapiens
  Light chain CDR3 for antibody 1531 (IGKV1-5)
QHYNIYPYT

SEQ ID NO: 3062 - protein, 13 aa, Homo sapiens
  Heavy chain CDR3 for antibody 1531 (IGHV3-53)
ARDGYCRGGSCYH

SEQ ID NO: 3063 - protein, 9 aa, Homo sapiens
  Light chain CDR3 for antibody 1532 (IGKV1-39)
QQSYNIHRT

SEQ ID NO: 3064 - protein, 12 aa, Homo sapiens
  Heavy chain CDR3 for antibody 1532 (IGHV3-15)
TTDSRTLYALDV

SEQ ID NO: 3065 - protein, 10 aa, Homo sapiens
  Light chain CDR3 for antibody 1533 (IGKV3-11)
QQRSNWPAGT

SEQ ID NO: 3066 - protein, 11 aa, Homo sapiens
  Heavy chain CDR3 for antibody 1533 (IGHV3-53)
ARDLVVYGMDV

SEQ ID NO: 3067 - protein, 9 aa, Homo sapiens
  Light chain CDR3 for antibody 1534 (IGKV1-33)
QQYDNLPQT

SEQ ID NO: 3068 - protein, 11 aa, Homo sapiens
  Heavy chain CDR3 for antibody 1534 (IGHV5-51)
ARSPTTNTFDY

SEQ ID NO: 3069 - protein, 9 aa, Homo sapiens
  Light chain CDR3 for antibody 1535 (IGKV1-39)
QQNLVIPRA

SEQ ID NO: 3070 - protein, 12 aa, Homo sapiens
  Heavy chain CDR3 for antibody 1535 (IGHV3-15)
TTIRSPLYPFDY

SEQ ID NO: 3071 - protein, 10 aa, Homo sapiens
  Light chain CDR3 for antibody 1536 (IGKV3-15)
QQYNNWPPIT

SEQ ID NO: 3072 - protein, 19 aa, Homo sapiens
  Heavy chain CDR3 for antibody 1536 (IGHV3/OR16-1)
ARGPRTCTTTSCHPYAFGD

SEQ ID NO: 3073 - protein, 9 aa, Homo sapiens
  Light chain CDR3 for antibody 1537 (IGKV1-9)
QQLNSDPPP

SEQ ID NO: 3074 - protein, 11 aa, Homo sapiens
  Heavy chain CDR3 for antibody 1537 (IGHV3-53)
ARDYGDFYFDY

SEQ ID NO: 3075 - protein, 9 aa, Homo sapiens
  Light chain CDR3 for antibody 1538 (IGKV3-20)
QQYGSSLWT

SEQ ID NO: 3076 - protein, 13 aa, Homo sapiens
  Heavy chain CDR3 for antibody 1538 (IGHV3-53)
ARDGYCRGGSCNH

SEQ ID NO: 3077 - protein, 9 aa, Homo sapiens
  Light chain CDR3 for antibody 1539 (IGKV1-5)
QHYNIYPYT

SEQ ID NO: 3078 - protein, 13 aa, Homo sapiens
  Heavy chain CDR3 for antibody 1539 (IGHV5-51)
ARQLCGGDCAFDY

SEQ ID NO: 3079 - protein, 10 aa, Homo sapiens
  Light chain CDR3 for antibody 1540 (IGKV1-39)
QQSYSTPPWT

SEQ ID NO: 3080 - protein, 9 aa, Homo sapiens
  Heavy chain CDR3 for antibody 1540 (IGHV3-53)
ARDAPENGD

SEQ ID NO: 3081 - protein, 11 aa, Homo sapiens
  Light chain CDR3 for antibody 1541 (IGKV3-11)
QQRSNWPPRYT

SEQ ID NO: 3082 - protein, 12 aa, Homo sapiens
  Heavy chain CDR3 for antibody 1541 (IGHV1/OR15-9)
ARVEVGATFVDY

SEQ ID NO: 3083 - protein, 8 aa, Homo sapiens
  Light chain CDR3 for antibody 1542 (IGKV1-12)
QQANSFPL

SEQ ID NO: 3084 - protein, 12 aa, Homo sapiens
  Heavy chain CDR3 for antibody 1542 (IGHV3-53)
AREIPSGSYWDY

SEQ ID NO: 3085 - protein, 8 aa, Homo sapiens
  Light chain CDR3 for antibody 1543 (IGKV1-39)
QQYYSTPS

SEQ ID NO: 3086 - protein, 16 aa, Homo sapiens
  Heavy chain CDR3 for antibody 1543 (IGHV1-58)
AAPYCSGGSCFDAFDI

SEQ ID NO: 3087 - protein, 9 aa, Homo sapiens
  Light chain CDR3 for antibody 1544 (IGKV3-20)
QQYGSSLWT

SEQ ID NO: 3088 - protein, 11 aa, Homo sapiens
  Heavy chain CDR3 for antibody 1544 (IGHV1-69)
ARDLVVYGMDV

SEQ ID NO: 3089 - protein, 8 aa, Homo sapiens
  Light chain CDR3 for antibody 1545 (IGKV1-39)
QQSYSMYT

SEQ ID NO: 3090 - protein, 11 aa, Homo sapiens
  Heavy chain CDR3 for antibody 1545 (IGHV3-53)
ARDRYSYGLDY

SEQ ID NO: 3091 - protein, 9 aa, Homo sapiens
  Light chain CDR3 for antibody 1546 (IGKV1-33)
QQYDNLPQT

SEQ ID NO: 3092 - protein, 11 aa, Homo sapiens
  Heavy chain CDR3 for antibody 1546 (IGHV3-53)
ARDRGGDVFDI

SEQ ID NO: 3093 - protein, 8 aa, Homo sapiens
  Light chain CDR3 for antibody 1547 (IGKV1-12)
QQANSFPL

SEQ ID NO: 3094 - protein, 13 aa, Homo sapiens
  Heavy chain CDR3 for antibody 1547 (IGHV5-51)
ARQLCGGDCAFDY

SEQ ID NO: 3095 - protein, 9 aa, Homo sapiens
  Light chain CDR3 for antibody 1548 (IGKV1-33)
QQYDNLPQT

SEQ ID NO: 3096 - protein, 11 aa, Homo sapiens
  Heavy chain CDR3 for antibody 1548 (IGHV3-21)
AREVSVTDFDY

SEQ ID NO: 3097 - protein, 7 aa, Homo sapiens
  Light chain CDR3 for antibody 1549 (IGKV3-20)
QQYGSSL

SEQ ID NO: 3098 - protein, 11 aa, Homo sapiens
  Heavy chain CDR3 for antibody 1549 (IGHV5-51)
ARSPTTNTFDY

SEQ ID NO: 3099 - protein, 9 aa, Homo sapiens
  Light chain CDR3 for antibody 1550 (IGKV1-33)
QQYDNLPRT

SEQ ID NO: 3100 - protein, 13 aa, Homo sapiens
  Heavy chain CDR3 for antibody 1550 (IGHV3-38)
ARDGYCRGGSFDH

SEQ ID NO: 3101 - protein, 9 aa, Homo sapiens
  Light chain CDR3 for antibody 1551 (IGKV1-5)
QHYNIYPYT

SEQ ID NO: 3102 - protein, 16 aa, Homo sapiens
  Heavy chain CDR3 for antibody 1551 (IGHV1-58)
AAPYCSGGSCFDAFDI

SEQ ID NO: 3103 - protein, 10 aa, Homo sapiens
  Light chain CDR3 for antibody 1552 (IGKV1-9)
QQLNSYPGFT

SEQ ID NO: 3104 - protein, 11 aa, Homo sapiens
  Heavy chain CDR3 for antibody 1552 (IGHV3-53)
ARDRYSYGLDY

SEQ ID NO: 3105 - protein, 9 aa, Homo sapiens
  Light chain CDR3 for antibody 1553 (IGKV1-39)
QQSSSTPWT

SEQ ID NO: 3106 - protein, 14 aa, Homo sapiens
  Heavy chain CDR3 for antibody 1553 (IGHV1-18)
ARYGYRDYNKRYDS

SEQ ID NO: 3107 - protein, 9 aa, Homo sapiens
  Light chain CDR3 for antibody 1554 (IGKV1-39)
QQSYSTPLT

SEQ ID NO: 3108 - protein, 13 aa, Homo sapiens
  Heavy chain CDR3 for antibody 1554 (IGHV3-23)
AKDSRGSTDYFDY

SEQ ID NO: 3109 - protein, 9 aa, Homo sapiens
  Light chain CDR3 for antibody 1555 (IGKV1-33)
QQYDNLPQT

SEQ ID NO: 3110 - protein, 11 aa, Homo sapiens
  Heavy chain CDR3 for antibody 1555 (IGHV3-53)
ARDLDYYGMDV

SEQ ID NO: 3111 - protein, 10 aa, Homo sapiens
  Light chain CDR3 for antibody 1556 (IGKV1-39)
QQSYNTRALT

SEQ ID NO: 3112 - protein, 11 aa, Homo sapiens
  Heavy chain CDR3 for antibody 1556 (IGHV3-53)
ARGHWEYYFDY

SEQ ID NO: 3113 - protein, 9 aa, Homo sapiens
  Light chain CDR3 for antibody 1557 (IGKV1-9)
QQLNSDPPP

SEQ ID NO: 3114 - protein, 12 aa, Homo sapiens
  Heavy chain CDR3 for antibody 1557 (IGHV3-53)
ARDLFEAGGMDV

SEQ ID NO: 3115 - protein, 9 aa, Homo sapiens
  Light chain CDR3 for antibody 1558 (IGKV1-39)
QQSYSTPLT

SEQ ID NO: 3116 - protein, 10 aa, Homo sapiens
  Heavy chain CDR3 for antibody 1558 (IGHV1-18)
ARDYYYGMDV

SEQ ID NO: 3117 - protein, 9 aa, Homo sapiens
  Light chain CDR3 for antibody 1559 (IGKV1-33)
QQYDNLPRT

SEQ ID NO: 3118 - protein, 15 aa, Homo sapiens
  Heavy chain CDR3 for antibody 1559 (IGHV1-69)
ARGQGPYSYYYYMDV

SEQ ID NO: 3119 - protein, 9 aa, Homo sapiens
  Light chain CDR3 for antibody 1560 (IGKV1-5)
QHYNIYPYT

SEQ ID NO: 3120 - protein, 11 aa, Homo sapiens
  Heavy chain CDR3 for antibody 1560 (IGHV3-53)
ARDYGDFYFDY

SEQ ID NO: 3121 - protein, 7 aa, Homo sapiens
  Light chain CDR3 for antibody 1561 (IGKV3-20)
QQYGSSL

SEQ ID NO: 3122 - protein, 11 aa, Homo sapiens
  Heavy chain CDR3 for antibody 1561 (IGHV3-53)
ARAYGDLHFDY

SEQ ID NO: 3123 - protein, 9 aa, Homo sapiens
  Light chain CDR3 for antibody 1562 (IGKV1-9)
QQLNSDPPP

SEQ ID NO: 3124 - protein, 13 aa, Homo sapiens
  Heavy chain CDR3 for antibody 1562 (IGHV3-23)
AKDSRGSTDYFDY

SEQ ID NO: 3125 - protein, 9 aa, Homo sapiens
  Light chain CDR3 for antibody 1563 (IGKV1-5)
QHYNIYPYT

SEQ ID NO: 3126 - protein, 11 aa, Homo sapiens
  Heavy chain CDR3 for antibody 1563 (IGHV3-53)
ARDRYSYGLDY

SEQ ID NO: 3127 - protein, 10 aa, Homo sapiens
  Light chain CDR3 for antibody 1564 (IGKV3-15)
QQYNKWPPWT

SEQ ID NO: 3128 - protein, 13 aa, Homo sapiens
  Heavy chain CDR3 for antibody 1564 (IGHV3-53)
AKAVGTLRYYMDV

SEQ ID NO: 3129 - protein, 10 aa, Homo sapiens
  Light chain CDR3 for antibody 1565 (IGKV1-39)
QQSYSTPPWT

SEQ ID NO: 3130 - protein, 14 aa, Homo sapiens
  Heavy chain CDR3 for antibody 1565 (IGHV1-69)
AREVEMATLYGMDV

SEQ ID NO: 3131 - protein, 10 aa, Homo sapiens
  Light chain CDR3 for antibody 1566 (IGKV1-39)
QQSYSTPPIT

SEQ ID NO: 3132 - protein, 12 aa, Homo sapiens
  Heavy chain CDR3 for antibody 1566 (IGHV3-13)
ARPTLSRGGMDV

SEQ ID NO: 3133 - protein, 10 aa, Homo sapiens
  Light chain CDR3 for antibody 1567 (IGKV1-39)
QQSYVTPGLT

SEQ ID NO: 3134 - protein, 13 aa, Homo sapiens
  Heavy chain CDR3 for antibody 1567 (IGHV5-51)
ARQLCGGDCAFDY

SEQ ID NO: 3135 - protein, 9 aa, Homo sapiens
  Light chain CDR3 for antibody 1568 (IGKV3-20)
QQYGSSLWT

SEQ ID NO: 3136 - protein, 11 aa, Homo sapiens
  Heavy chain CDR3 for antibody 1568 (IGHV3-53)
ARDRGSGWYDY

SEQ ID NO: 3137 - protein, 9 aa, Homo sapiens
  Light chain CDR3 for antibody 1569 (IGKV1-5)
QHYNIYPYT

SEQ ID NO: 3138 - protein, 12 aa, Homo sapiens
  Heavy chain CDR3 for antibody 1569 (IGHV3-53)
ARPTLSRGGMDV

SEQ ID NO: 3139 - protein, 8 aa, Homo sapiens
  Light chain CDR3 for antibody 1570 (IGKV1-12)
QQANSFPL

SEQ ID NO: 3140 - protein, 15 aa, Homo sapiens
  Heavy chain CDR3 for antibody 1570 (IGHV1-69)
ARGQGPYSYYYYMDV

SEQ ID NO: 3141 - protein, 9 aa, Homo sapiens
  Light chain CDR3 for antibody 1571 (IGKV1-12)
QQANSFPWT

SEQ ID NO: 3142 - protein, 11 aa, Homo sapiens
  Heavy chain CDR3 for antibody 1571 (IGHV3-53)
ARDRVVYGMDV

SEQ ID NO: 3143 - protein, 9 aa, Homo sapiens
  Light chain CDR3 for antibody 1572 (IGKV1-33)
QQYDNLPQT

SEQ ID NO: 3144 - protein, 14 aa, Homo sapiens
  Heavy chain CDR3 for antibody 1572 (IGHV4-39)
ASGDYGDYHRGFDY

SEQ ID NO: 3145 - protein, 7 aa, Homo sapiens
  Light chain CDR3 for antibody 1573 (IGKV3-20)
QQYGSSL

SEQ ID NO: 3146 - protein, 19 aa, Homo sapiens
  Heavy chain CDR3 for antibody 1573 (IGHV1-69)
ARGVRYCSGGSCYGAHFQH

SEQ ID NO: 3147 - protein, 9 aa, Homo sapiens
  Light chain CDR3 for antibody 1574 (IGKV1-33)
QQYDNLPRT

SEQ ID NO: 3148 - protein, 13 aa, Homo sapiens
  Heavy chain CDR3 for antibody 1574 (IGHV1-3)
ARGAVTNYDYFDY

SEQ ID NO: 3149 - protein, 10 aa, Homo sapiens
  Light chain CDR3 for antibody 1575 (IGKV1-9)
QQLNSYPPVT

SEQ ID NO: 3150 - protein, 11 aa, Homo sapiens
  Heavy chain CDR3 for antibody 1575 (IGHV3-53)
ARDRVVYGMDV

SEQ ID NO: 3151 - protein, 9 aa, Homo sapiens
  Light chain CDR3 for antibody 1576 (IGKV1-5)
QHYNIYPYT

SEQ ID NO: 3152 - protein, 11 aa, Homo sapiens
  Heavy chain CDR3 for antibody 1576 (IGHV3-53)
ARDRGSGWYDY

SEQ ID NO: 3153 - protein, 10 aa, Homo sapiens
  Light chain CDR3 for antibody 1577 (IGKV1-33)
QQYDNLPQYN

SEQ ID NO: 3154 - protein, 13 aa, Homo sapiens
  Heavy chain CDR3 for antibody 1577 (IGHV3-53)
ARDGYCRGGSCYH

SEQ ID NO: 3155 - protein, 7 aa, Homo sapiens
  Light chain CDR3 for antibody 1578 (IGKV2-30)
MQGSPGT

SEQ ID NO: 3156 - protein, 12 aa, Homo sapiens
  Heavy chain CDR3 for antibody 1578 (IGHV1-18)
ARAHSSGSAFDP

SEQ ID NO: 3157 - protein, 10 aa, Homo sapiens
  Light chain CDR3 for antibody 1579 (IGKV1-9)
QQLNSYPGYT

SEQ ID NO: 3158 - protein, 16 aa, Homo sapiens
  Heavy chain CDR3 for antibody 1579 (IGHV1-58)
AAPYCSGGSCFDAFDI

SEQ ID NO: 3159 - protein, 9 aa, Homo sapiens
  Light chain CDR3 for antibody 1580 (IGKV1-39)
QQLKSYPLT

SEQ ID NO: 3160 - protein, 15 aa, Homo sapiens
  Heavy chain CDR3 for antibody 1580 (IGHV4-30-4)
ARVDVVDPAAAQFDP

SEQ ID NO: 3161 - protein, 8 aa, Homo sapiens
  Light chain CDR3 for antibody 1581 (IGKV1-39)
QQSYSMYT

SEQ ID NO: 3162 - protein, 11 aa, Homo sapiens
  Heavy chain CDR3 for antibody 1581 (IGHV3-53)
ARDRVVYGMDV

SEQ ID NO: 3163 - protein, 8 aa, Homo sapiens
  Light chain CDR3 for antibody 1582 (IGKV1-12)
QQANSFPL

SEQ ID NO: 3164 - protein, 16 aa, Homo sapiens
  Heavy chain CDR3 for antibody 1582 (IGHV3-64)
ARDSGDSPALVTWFDY

SEQ ID NO: 3165 - protein, 9 aa, Homo sapiens
  Light chain CDR3 for antibody 1583 (IGKV3-20)
QQYGSSLWT

SEQ ID NO: 3166 - protein, 12 aa, Homo sapiens
  Heavy chain CDR3 for antibody 1583 (IGHV3-53)
ARPTLSRGGMDV

SEQ ID NO: 3167 - protein, 8 aa, Homo sapiens
  Light chain CDR3 for antibody 1584 (IGKV1-39)
QQSYSTPW

SEQ ID NO: 3168 - protein, 14 aa, Homo sapiens
  Heavy chain CDR3 for antibody 1584 (IGHV1-18)
ARGGYASVTAPFDY

SEQ ID NO: 3169 - protein, 8 aa, Homo sapiens
  Light chain CDR3 for antibody 1585 (IGKV4-1)
QQYYSTPS

SEQ ID NO: 3170 - protein, 17 aa, Homo sapiens
  Heavy chain CDR3 for antibody 1585 (IGHV1-69)
ARGPPLPSSGWSEIWVY

SEQ ID NO: 3171 - protein, 9 aa, Homo sapiens
  Light chain CDR3 for antibody 1586 (IGKV1-33)
QQYDNLPRT

SEQ ID NO: 3172 - protein, 21 aa, Homo sapiens
  Heavy chain CDR3 for antibody 1586 (IGHV2-5)
AQRLGYCSSTSCYNRFVAFDI

SEQ ID NO: 3173 - protein, 9 aa, Homo sapiens
  Light chain CDR3 for antibody 1587 (IGKV1-39)
QQNLVIPRA

SEQ ID NO: 3174 - protein, 16 aa, Homo sapiens
  Heavy chain CDR3 for antibody 1587 (IGHV1-58)
AAPYCSGGSCFDAFDI

SEQ ID NO: 3175 - protein, 9 aa, Homo sapiens
  Light chain CDR3 for antibody 1588 (IGKV1-27)
QKYNSVSDT

SEQ ID NO: 3176 - protein, 11 aa, Homo sapiens
  Heavy chain CDR3 for antibody 1588 (IGHV3-53)
ARDLAVYGMDV

SEQ ID NO: 3177 - protein, 9 aa, Homo sapiens
  Light chain CDR3 for antibody 1589 (IGKV1-9)
QQLNSYPLT

SEQ ID NO: 3178 - protein, 13 aa, Homo sapiens
  Heavy chain CDR3 for antibody 1589 (IGHV5-51)
ARQLCGGDCAFDY

SEQ ID NO: 3179 - protein, 9 aa, Homo sapiens
  Light chain CDR3 for antibody 1590 (IGKV1-33)
QQYDNLPRT

SEQ ID NO: 3180 - protein, 19 aa, Homo sapiens
  Heavy chain CDR3 for antibody 1590 (IGHV1-3)
ATGLGKHDYSNYVVDYMDV

SEQ ID NO: 3181 - protein, 9 aa, Homo sapiens
  Light chain CDR3 for antibody 1591 (IGKV1-27)
QKYNSVSDT

SEQ ID NO: 3182 - protein, 13 aa, Homo sapiens
  Heavy chain CDR3 for antibody 1591 (IGHV3-23)
AKDSRGSTDYFDY

SEQ ID NO: 3183 - protein, 10 aa, Homo sapiens
  Light chain CDR3 for antibody 1592 (IGKV1-39)
QQSYVTPGLT

SEQ ID NO: 3184 - protein, 11 aa, Homo sapiens
  Heavy chain CDR3 for antibody 1592 (IGHV3-53)
ARGHWEYYFDY

SEQ ID NO: 3185 - protein, 10 aa, Homo sapiens
  Light chain CDR3 for antibody 1593 (IGKV1-5)
QQYDTYSPTT

SEQ ID NO: 3186 - protein, 13 aa, Homo sapiens
  Heavy chain CDR3 for antibody 1593 (IGHV1-69)
AVLYGDYRNAFDS

SEQ ID NO: 3187 - protein, 8 aa, Homo sapiens
  Light chain CDR3 for antibody 1594 (IGKV1-12)
QQANSFPL

SEQ ID NO: 3188 - protein, 12 aa, Homo sapiens
  Heavy chain CDR3 for antibody 1594 (IGHV3-53)
ARAPLGTDYFDS

SEQ ID NO: 3189 - protein, 9 aa, Homo sapiens
  Light chain CDR3 for antibody 1595 (IGKV1-33)
QQYDNLPRT

SEQ ID NO: 3190 - protein, 16 aa, Homo sapiens
  Heavy chain CDR3 for antibody 1595 (IGHV3-66)
AKPLFTYSYGQNYFDY

SEQ ID NO: 3191 - protein, 9 aa, Homo sapiens
  Light chain CDR3 for antibody 1596 (IGKV1-5)
QHYNIYPYT

SEQ ID NO: 3192 - protein, 15 aa, Homo sapiens
  Heavy chain CDR3 for antibody 1596 (IGHV1-69)
ARGQGPYSYYYYMDV

SEQ ID NO: 3193 - protein, 9 aa, Homo sapiens
  Light chain CDR3 for antibody 1597 (IGKV3-20)
QQYGSSPGT

SEQ ID NO: 3194 - protein, 12 aa, Homo sapiens
  Heavy chain CDR3 for antibody 1597 (IGHV3-53)
ARDLDVAGAFDI

SEQ ID NO: 3195 - protein, 9 aa, Homo sapiens
  Light chain CDR3 for antibody 1598 (IGKV1-39)
QQNLVIPRA

SEQ ID NO: 3196 - protein, 15 aa, Homo sapiens
  Heavy chain CDR3 for antibody 1598 (IGHV3-11)
ARNPAGSSLWPYMDV

SEQ ID NO: 3197 - protein, 8 aa, Homo sapiens
  Light chain CDR3 for antibody 1599 (IGKV1-12)
QQANSFPL

SEQ ID NO: 3198 - protein, 11 aa, Homo sapiens
  Heavy chain CDR3 for antibody 1599 (IGHV3-53)
ARDYGDFYFDY

SEQ ID NO: 3199 - protein, 8 aa, Homo sapiens
  Light chain CDR3 for antibody 1600 (IGKV1-5)
QQYNSYSA

SEQ ID NO: 3200 - protein, 13 aa, Homo sapiens
  Heavy chain CDR3 for antibody 1600 (IGHV5-51)
ARQLCGGDCAFDY

SEQ ID NO: 3201 - protein, 8 aa, Homo sapiens
  Light chain CDR3 for antibody 1601 (IGKV1-39)
QQSYSMYT

SEQ ID NO: 3202 - protein, 11 aa, Homo sapiens
  Heavy chain CDR3 for antibody 1601 (IGHV3-53)
ARDYGDFYFDY

SEQ ID NO: 3203 - protein, 7 aa, Homo sapiens
  Light chain CDR3 for antibody 1602 (IGKV3-20)
QQYGSSL

SEQ ID NO: 3204 - protein, 20 aa, Homo sapiens
  Heavy chain CDR3 for antibody 1602 (IGHV3-30)
AKEEGKRWLQIYYYYYGMDV

SEQ ID NO: 3205 - protein, 9 aa, Homo sapiens
  Light chain CDR3 for antibody 1603 (IGKV1-33)
QQYDNLPRT

SEQ ID NO: 3206 - protein, 9 aa, Homo sapiens
  Heavy chain CDR3 for antibody 1603 (IGHV3-53)
ARDAPENGD

SEQ ID NO: 3207 - protein, 8 aa, Homo sapiens
  Light chain CDR3 for antibody 1604 (IGKV3-15)
QQYNNWGT

SEQ ID NO: 3208 - protein, 11 aa, Homo sapiens
  Heavy chain CDR3 for antibody 1604 (IGHV3-53)
ARDIVVYGMDV

SEQ ID NO: 3209 - protein, 7 aa, Homo sapiens
  Light chain CDR3 for antibody 1605 (IGKV3-20)
QQYGSSL

SEQ ID NO: 3210 - protein, 10 aa, Homo sapiens
  Heavy chain CDR3 for antibody 1605 (IGHV5-a)
ARLNGAAMVT

SEQ ID NO: 3211 - protein, 9 aa, Homo sapiens
  Light chain CDR3 for antibody 1606 (IGKV1-39)
QQSYSTPLT

SEQ ID NO: 3212 - protein, 16 aa, Homo sapiens
  Heavy chain CDR3 for antibody 1606 (IGHV3-64)
ARDSGDSPALVTWFDY

SEQ ID NO: 3213 - protein, 9 aa, Homo sapiens
  Light chain CDR3 for antibody 1607 (IGKV3-20)
QQYGSSPRT

SEQ ID NO: 3214 - protein, 11 aa, Homo sapiens
  Heavy chain CDR3 for antibody 1607 (IGHV3-53)
ARDRVVYGMDV

SEQ ID NO: 3215 - protein, 8 aa, Homo sapiens
  Light chain CDR3 for antibody 1608 (IGKV3-15)
QQYNNWGT

SEQ ID NO: 3216 - protein, 19 aa, Homo sapiens
  Heavy chain CDR3 for antibody 1608 (IGHV1-69)
ATGLGKHDYSNYVVDYMDV

SEQ ID NO: 3217 - protein, 9 aa, Homo sapiens
  Light chain CDR3 for antibody 1609 (IGKV3-20)
QQYGSSLWT

SEQ ID NO: 3218 - protein, 13 aa, Homo sapiens
  Heavy chain CDR3 for antibody 1609 (IGHV1-3)
ARGAVTNYDYFDY

SEQ ID NO: 3219 - protein, 9 aa, Homo sapiens
  Light chain CDR3 for antibody 1610 (IGKV3-20)
QQYGSSLWT

SEQ ID NO: 3220 - protein, 11 aa, Homo sapiens
  Heavy chain CDR3 for antibody 1610 (IGHV3-21)
AREVSVTDFDY

SEQ ID NO: 3221 - protein, 8 aa, Homo sapiens
  Light chain CDR3 for antibody 1611 (IGKV3-15)
QQYNNWGT

SEQ ID NO: 3222 - protein, 17 aa, Homo sapiens
  Heavy chain CDR3 for antibody 1611 (IGHV1-69)
ARGPPLPSSGWSEIWVY

SEQ ID NO: 3223 - protein, 7 aa, Homo sapiens
  Light chain CDR3 for antibody 1612 (IGKV3-20)
QQYGSSL

SEQ ID NO: 3224 - protein, 20 aa, Homo sapiens
  Heavy chain CDR3 for antibody 1612 (IGHV3-NL1)
AKQVGEYCSGGSCYSYYFDY

SEQ ID NO: 3225 - protein, 9 aa, Homo sapiens
  Light chain CDR3 for antibody 1613 (IGKV4-1)
QQYYNFRRS

SEQ ID NO: 3226 - protein, 17 aa, Homo sapiens
  Heavy chain CDR3 for antibody 1613 (IGHV4-61)
AREKHCGGEGCLGGIDY

SEQ ID NO: 3227 - protein, 9 aa, Homo sapiens
  Light chain CDR3 for antibody 1614 (IGKV3-20)
QQYGSSLWT

SEQ ID NO: 3228 - protein, 17 aa, Homo sapiens
  Heavy chain CDR3 for antibody 1614 (IGHV1-69)
ARGPPLPSSGWSEIWVY

SEQ ID NO: 3229 - protein, 7 aa, Homo sapiens
  Light chain CDR3 for antibody 1615 (IGKV3-20)
QQYGSSL

SEQ ID NO: 3230 - protein, 12 aa, Homo sapiens
  Heavy chain CDR3 for antibody 1615 (IGHV3-53)
ARDLTAIRGFDY

SEQ ID NO: 3231 - protein, 9 aa, Homo sapiens
  Light chain CDR3 for antibody 1616 (IGKV3-20)
QQYGSSLWT

SEQ ID NO: 3232 - protein, 18 aa, Homo sapiens
  Heavy chain CDR3 for antibody 1616 (IGHV3-15)
TTDRGFRYQLLEHDAFDI

SEQ ID NO: 3233 - protein, 9 aa, Homo sapiens
  Light chain CDR3 for antibody 1617 (IGKV2D-28)
MQALQTPCT

SEQ ID NO: 3234 - protein, 11 aa, Homo sapiens
  Heavy chain CDR3 for antibody 1617 (IGHV1-18)
ARGHWEYYFDY

SEQ ID NO: 3235 - protein, 10 aa, Homo sapiens
  Light chain CDR3 for antibody 1618 (IGKV3-11)
QQRSNWPAGT

SEQ ID NO: 3236 - protein, 13 aa, Homo sapiens
  Heavy chain CDR3 for antibody 1618 (IGHV5-51)
ARQLCGGDCAFDY

SEQ ID NO: 3237 - protein, 9 aa, Homo sapiens
  Light chain CDR3 for antibody 1619 (IGKV1-39)
QQTYSTPYT

SEQ ID NO: 3238 - protein, 18 aa, Homo sapiens
  Heavy chain CDR3 for antibody 1619 (IGHV1-2)
ARDIVMIVPNNAYNWFDP

SEQ ID NO: 3239 - protein, 9 aa, Homo sapiens
  Light chain CDR3 for antibody 1620 (IGKV1-39)
QQSYSTPYT

SEQ ID NO: 3240 - protein, 14 aa, Homo sapiens
  Heavy chain CDR3 for antibody 1620 (IGHV1-69)
ARDLIAVAGGYFDY

SEQ ID NO: 3241 - protein, 8 aa, Homo sapiens
  Light chain CDR3 for antibody 1621 (IGKV1-12)
QQANSFPL

SEQ ID NO: 3242 - protein, 14 aa, Homo sapiens
  Heavy chain CDR3 for antibody 1621 (IGHV4-39)
ASGDYGDYHRGFDY

SEQ ID NO: 3243 - protein, 7 aa, Homo sapiens
  Light chain CDR3 for antibody 1622 (IGKV3-20)
QQYGSSL

SEQ ID NO: 3244 - protein, 18 aa, Homo sapiens
  Heavy chain CDR3 for antibody 1622 (IGHV3-15)
TTDRGFRYQLLEHDAFDI

SEQ ID NO: 3245 - protein, 8 aa, Homo sapiens
  Light chain CDR3 for antibody 1623 (IGKV1-12)
QQSYSTLT

SEQ ID NO: 3246 - protein, 14 aa, Homo sapiens
  Heavy chain CDR3 for antibody 1623 (IGHV4-39)
ASGDYGDYHRGFDY

SEQ ID NO: 3247 - protein, 10 aa, Homo sapiens
  Light chain CDR3 for antibody 1624 (IGKV1-33)
QQYDNLPQYN

SEQ ID NO: 3248 - protein, 12 aa, Homo sapiens
  Heavy chain CDR3 for antibody 1624 (IGHV3-53)
ARPTLSRGGMDV

SEQ ID NO: 3249 - protein, 9 aa, Homo sapiens
  Light chain CDR3 for antibody 1625 (IGKV1-5)
QQYNSYPVT

SEQ ID NO: 3250 - protein, 17 aa, Homo sapiens
  Heavy chain CDR3 for antibody 1625 (IGHV4-4)
ARGGRNSSRYPRSWFDP

SEQ ID NO: 3251 - protein, 8 aa, Homo sapiens
  Light chain CDR3 for antibody 1626 (IGKV1-12)
QQANSFPL

SEQ ID NO: 3252 - protein, 13 aa, Homo sapiens
  Heavy chain CDR3 for antibody 1626 (IGHV3-23)
AKDSRGSTDYFDY

SEQ ID NO: 3253 - protein, 9 aa, Homo sapiens
  Light chain CDR3 for antibody 1627 (IGKV1-27)
QKYNSVSDT

SEQ ID NO: 3254 - protein, 12 aa, Homo sapiens
  Heavy chain CDR3 for antibody 1627 (IGHV3-53)
ARDLFEAGGMDV

SEQ ID NO: 3255 - protein, 9 aa, Homo sapiens
  Light chain CDR3 for antibody 1628 (IGKV1-27)
QKYNSALLA

SEQ ID NO: 3256 - protein, 22 aa, Homo sapiens
  Heavy chain CDR3 for antibody 1628 (IGHV1-18)
ARTDSITIFGVVSLSDVGYFDY

SEQ ID NO: 3257 - protein, 8 aa, Homo sapiens
  Light chain CDR3 for antibody 1629 (IGKV1-39)
QQTYSTPG

SEQ ID NO: 3258 - protein, 11 aa, Homo sapiens
  Heavy chain CDR3 for antibody 1629 (IGHV3-21)
AREVSVTDFDY

SEQ ID NO: 3259 - protein, 7 aa, Homo sapiens
  Light chain CDR3 for antibody 1630 (IGKV3-20)
QQYGSSL

SEQ ID NO: 3260 - protein, 12 aa, Homo sapiens
  Heavy chain CDR3 for antibody 1630 (IGHV3-53)
ARDLSVAGAFDI

SEQ ID NO: 3261 - protein, 9 aa, Homo sapiens
  Light chain CDR3 for antibody 1631 (IGKV1-5)
QHYNIYPYT

SEQ ID NO: 3262 - protein, 12 aa, Homo sapiens
  Heavy chain CDR3 for antibody 1631 (IGHV3-53)
AREIPSGSYWDY

SEQ ID NO: 3263 - protein, 9 aa, Homo sapiens
  Light chain CDR3 for antibody 1632 (IGKV1-5)
QQYNSYSYT

SEQ ID NO: 3264 - protein, 20 aa, Homo sapiens
  Heavy chain CDR3 for antibody 1632 (IGHV3-11)
ARPQGGWFGEEVDNYYGMDV

SEQ ID NO: 3265 - protein, 9 aa, Homo sapiens
  Light chain CDR3 for antibody 1633 (IGKV1-5)
QQYKSYSQT

SEQ ID NO: 3266 - protein, 13 aa, Homo sapiens
  Heavy chain CDR3 for antibody 1633 (IGHV3-64)
ARDGYCRGGSCYH

SEQ ID NO: 3267 - protein, 9 aa, Homo sapiens
  Light chain CDR3 for antibody 1634 (IGKV1-33)
QQYDNLPQT

SEQ ID NO: 3268 - protein, 9 aa, Homo sapiens
  Heavy chain CDR3 for antibody 1634 (IGHV3-53)
ARECYCMDV

SEQ ID NO: 3269 - protein, 9 aa, Homo sapiens
  Light chain CDR3 for antibody 1635 (IGKV1-33)
QQYDNLPQT

SEQ ID NO: 3270 - protein, 12 aa, Homo sapiens
  Heavy chain CDR3 for antibody 1635 (IGHV3-53)
ARAPLGTDYFDS

SEQ ID NO: 3271 - protein, 9 aa, Homo sapiens
  Light chain CDR3 for antibody 1636 (IGKV1-9)
QQLNSDPPP

SEQ ID NO: 3272 - protein, 14 aa, Homo sapiens
  Heavy chain CDR3 for antibody 1636 (IGHV4-39)
ASGDYGDYHRGFDY

SEQ ID NO: 3273 - protein, 8 aa, Homo sapiens
  Light chain CDR3 for antibody 1637 (IGKV3-15)
QQYNNWGT

SEQ ID NO: 3274 - protein, 14 aa, Homo sapiens
  Heavy chain CDR3 for antibody 1637 (IGHV1-69)
AREVEMATLYGMDV

SEQ ID NO: 3275 - protein, 9 aa, Homo sapiens
  Light chain CDR3 for antibody 1638 (IGKV3-20)
QQYGSSLWT

SEQ ID NO: 3276 - protein, 11 aa, Homo sapiens
  Heavy chain CDR3 for antibody 1638 (IGHV5-51)
ARSPTTNTFDY

SEQ ID NO: 3277 - protein, 9 aa, Homo sapiens
  Light chain CDR3 for antibody 1639 (IGKV3-20)
QQYGSSPGT

SEQ ID NO: 3278 - protein, 18 aa, Homo sapiens
  Heavy chain CDR3 for antibody 1639 (IGHV4-34)
ARVSGWAFWTKSPHYFDY

SEQ ID NO: 3279 - protein, 10 aa, Homo sapiens
  Light chain CDR3 for antibody 1640 (IGKV1-33)
QQYDNLPRYT

SEQ ID NO: 3280 - protein, 12 aa, Homo sapiens
  Heavy chain CDR3 for antibody 1640 (IGHV3-53)
AREIPSGSYSDY

SEQ ID NO: 3281 - protein, 10 aa, Homo sapiens
  Light chain CDR3 for antibody 1641 (IGKV3D-15)
QQYSTWPAGT

SEQ ID NO: 3282 - protein, 15 aa, Homo sapiens
  Heavy chain CDR3 for antibody 1641 (IGHV4-34)
AHNLAEAGTGNWFDP

SEQ ID NO: 3283 - protein, 10 aa, Homo sapiens
  Light chain CDR3 for antibody 1642 (IGKV1-9)
QQLNSYPPVT

SEQ ID NO: 3284 - protein, 12 aa, Homo sapiens
  Heavy chain CDR3 for antibody 1642 (IGHV3-53)
ARPTLSRGGMDV

SEQ ID NO: 3285 - protein, 8 aa, Homo sapiens
  Light chain CDR3 for antibody 1643 (IGKV1-39)
QQSYSTPS

SEQ ID NO: 3286 - protein, 14 aa, Homo sapiens
  Heavy chain CDR3 for antibody 1643 (IGHV1-69)
ASEDCYSTSCGSDY

SEQ ID NO: 3287 - protein, 7 aa, Homo sapiens
  Light chain CDR3 for antibody 1644 (IGKV1-9)
QQLNSYS

SEQ ID NO: 3288 - protein, 11 aa, Homo sapiens
  Heavy chain CDR3 for antibody 1644 (IGHV3-53)
ARDRYSYGLDY

SEQ ID NO: 3289 - protein, 8 aa, Homo sapiens
  Light chain CDR3 for antibody 1645 (IGKV1-12)
QQANSFPL

SEQ ID NO: 3290 - protein, 14 aa, Homo sapiens
  Heavy chain CDR3 for antibody 1645 (IGHV3-53)
ARLFYGGNSAGVDY

SEQ ID NO: 3291 - protein, 10 aa, Homo sapiens
  Light chain CDR3 for antibody 1646 (IGKV1-39)
QQSYSTPPIT

SEQ ID NO: 3292 - protein, 13 aa, Homo sapiens
  Heavy chain CDR3 for antibody 1646 (IGHV5-51)
ARQLCGGDCAFDY

SEQ ID NO: 3293 - protein, 9 aa, Homo sapiens
  Light chain CDR3 for antibody 1647 (IGKV1-33)
QQYDNLPQT

SEQ ID NO: 3294 - protein, 14 aa, Homo sapiens
  Heavy chain CDR3 for antibody 1647 (IGHV1-69)
ARYGVSYGDYLPDY

SEQ ID NO: 3295 - protein, 10 aa, Homo sapiens
  Light chain CDR3 for antibody 1648 (IGKV1-9)
QQLNSYPGYT

SEQ ID NO: 3296 - protein, 13 aa, Homo sapiens
  Heavy chain CDR3 for antibody 1648 (IGHV1-69)
ARDGYCRGGSCYH

SEQ ID NO: 3297 - protein, 10 aa, Homo sapiens
  Light chain CDR3 for antibody 1649 (IGKV3-11)
QQRSNWPAGT

SEQ ID NO: 3298 - protein, 11 aa, Homo sapiens
  Heavy chain CDR3 for antibody 1649 (IGHV3-53)
ARAYGDYYFDY

SEQ ID NO: 3299 - protein, 7 aa, Homo sapiens
  Light chain CDR3 for antibody 1650 (IGKV1-9)
QQLNSYS

SEQ ID NO: 3300 - protein, 16 aa, Homo sapiens
  Heavy chain CDR3 for antibody 1650 (IGHV1-58)
AAPYCSGGSCFDAFDI

SEQ ID NO: 3301 - protein, 10 aa, Homo sapiens
  Light chain CDR3 for antibody 1651 (IGKV1-9)
QQLNSYPPYT

SEQ ID NO: 3302 - protein, 13 aa, Homo sapiens
  Heavy chain CDR3 for antibody 1651 (IGHV5-51)
ARQLCGGDCAFDY

SEQ ID NO: 3303 - protein, 9 aa, Homo sapiens
  Light chain CDR3 for antibody 1652 (IGKV1-39)
QQSYSTPLT

SEQ ID NO: 3304 - protein, 19 aa, Homo sapiens
  Heavy chain CDR3 for antibody 1652 (IGHV1-69)
ARGVRYCSGGSCYGAHFQH

SEQ ID NO: 3305 - protein, 9 aa, Homo sapiens
  Light chain CDR3 for antibody 1653 (IGKV1-9)
QQYNSYPLT

SEQ ID NO: 3306 - protein, 11 aa, Homo sapiens
  Heavy chain CDR3 for antibody 1653 (IGHV3-53)
ARDRGSGWYDY

SEQ ID NO: 3307 - protein, 8 aa, Homo sapiens
  Light chain CDR3 for antibody 1654 (IGKV1-39)
QQSYSTPS

SEQ ID NO: 3308 - protein, 11 aa, Homo sapiens
  Heavy chain CDR3 for antibody 1654 (IGHV1-69)
ARDRGSGWYDY

SEQ ID NO: 3309 - protein, 9 aa, Homo sapiens
  Light chain CDR3 for antibody 1655 (IGKV1-12)
QQANSFPPT

SEQ ID NO: 3310 - protein, 21 aa, Homo sapiens
  Heavy chain CDR3 for antibody 1655 (IGHV2-5)
AERRGYCSSTSCYNRFGAFDI

SEQ ID NO: 3311 - protein, 9 aa, Homo sapiens
  Light chain CDR3 for antibody 1656 (IGKV1-33)
QQYDNLPQT

SEQ ID NO: 3312 - protein, 15 aa, Homo sapiens
  Heavy chain CDR3 for antibody 1656 (IGHV3-13)
ARDRGGYYTGYAFDI

SEQ ID NO: 3313 - protein, 10 aa, Homo sapiens
  Light chain CDR3 for antibody 1657 (IGKV1-33)
QQYDNLPQYN

SEQ ID NO: 3314 - protein, 14 aa, Homo sapiens
  Heavy chain CDR3 for antibody 1657 (IGHV4-39)
ASGDYGDYHRGFDY

SEQ ID NO: 3315 - protein, 9 aa, Homo sapiens
  Light chain CDR3 for antibody 1658 (IGKV1-27)
QKYNSVSDT

SEQ ID NO: 3316 - protein, 9 aa, Homo sapiens
  Heavy chain CDR3 for antibody 1658 (IGHV3-53)
ARDAPENGD

SEQ ID NO: 3317 - protein, 9 aa, Homo sapiens
  Light chain CDR3 for antibody 1659 (IGKV1-5)
QQYNSYPLT

SEQ ID NO: 3318 - protein, 9 aa, Homo sapiens
  Heavy chain CDR3 for antibody 1659 (IGHV1-69)
ARDAPENGD

SEQ ID NO: 3319 - protein, 7 aa, Homo sapiens
  Light chain CDR3 for antibody 1660 (IGKV1-9)
QQLNSYS

SEQ ID NO: 3320 - protein, 9 aa, Homo sapiens
  Heavy chain CDR3 for antibody 1660 (IGHV3-53)
ARDAPESGD

SEQ ID NO: 3321 - protein, 9 aa, Homo sapiens
  Light chain CDR3 for antibody 1661 (IGKV1-39)
QQSYSTPQT

SEQ ID NO: 3322 - protein, 11 aa, Homo sapiens
  Heavy chain CDR3 for antibody 1661 (IGHV3-53)
ARDIVVYGMDV

SEQ ID NO: 3323 - protein, 9 aa, Homo sapiens
  Light chain CDR3 for antibody 1662 (IGKV1-9)
QQLNSYPLT

SEQ ID NO: 3324 - protein, 11 aa, Homo sapiens
  Heavy chain CDR3 for antibody 1662 (IGHV3-21)
AREVSVTDFDY

SEQ ID NO: 3325 - protein, 9 aa, Homo sapiens
  Light chain CDR3 for antibody 1663 (IGKV1-27)
QKYNSVSDT

SEQ ID NO: 3326 - protein, 14 aa, Homo sapiens
  Heavy chain CDR3 for antibody 1663 (IGHV3-53)
ARLFYGGNSAGVDY

SEQ ID NO: 3327 - protein, 10 aa, Homo sapiens
  Light chain CDR3 for antibody 1664 (IGKV1-39)
QQSYNTRALT

SEQ ID NO: 3328 - protein, 19 aa, Homo sapiens
  Heavy chain CDR3 for antibody 1664 (IGHV1-3)
ATGLGKHDYSNYVVDYMDV

SEQ ID NO: 3329 - protein, 10 aa, Homo sapiens
  Light chain CDR3 for antibody 1665 (IGKV3-11)
QQRSNWPAGT

SEQ ID NO: 3330 - protein, 12 aa, Homo sapiens
  Heavy chain CDR3 for antibody 1665 (IGHV3-53)
ARPTLSRGGMDV

SEQ ID NO: 3331 - protein, 10 aa, Homo sapiens
  Light chain CDR3 for antibody 1666 (IGKV1-39)
QQSYSTPPLT

SEQ ID NO: 3332 - protein, 11 aa, Homo sapiens
  Heavy chain CDR3 for antibody 1666 (IGHV3-13)
ARDLDYYGMDV

SEQ ID NO: 3333 - protein, 9 aa, Homo sapiens
  Light chain CDR3 for antibody 1667 (IGKV3-20)
QQYGSSPRT

SEQ ID NO: 3334 - protein, 12 aa, Homo sapiens
  Heavy chain CDR3 for antibody 1667 (IGHV3-53)
ARAPLGTDYFDS

SEQ ID NO: 3335 - protein, 9 aa, Homo sapiens
  Light chain CDR3 for antibody 1668 (IGKV3-20)
QQYGSSPWT

SEQ ID NO: 3336 - protein, 16 aa, Homo sapiens
  Heavy chain CDR3 for antibody 1668 (IGHV1-58)
AAPYCSSTSCHDAFDI

SEQ ID NO: 3337 - protein, 9 aa, Homo sapiens
  Light chain CDR3 for antibody 1669 (IGKV1-9)
QQLNSDPPP

SEQ ID NO: 3338 - protein, 11 aa, Homo sapiens
  Heavy chain CDR3 for antibody 1669 (IGHV3-53)
ARDLDYYGMDV

SEQ ID NO: 3339 - protein, 10 aa, Homo sapiens
  Light chain CDR3 for antibody 1670 (IGKV1-12)
QQSYSNGSGT

SEQ ID NO: 3340 - protein, 13 aa, Homo sapiens
  Heavy chain CDR3 for antibody 1670 (IGHV5-51)
ARQLCGGDCAFDY

SEQ ID NO: 3341 - protein, 9 aa, Homo sapiens
  Light chain CDR3 for antibody 1671 (IGKV1-9)
QQLNSYPPI

SEQ ID NO: 3342 - protein, 13 aa, Homo sapiens
  Heavy chain CDR3 for antibody 1671 (IGHV3-53)
ARDGYCRGGSFYH

SEQ ID NO: 3343 - protein, 7 aa, Homo sapiens
  Light chain CDR3 for antibody 1672 (IGKV3-20)
QQYGSSL

SEQ ID NO: 3344 - protein, 17 aa, Homo sapiens
  Heavy chain CDR3 for antibody 1672 (IGHV5-51)
ARRQGRWYRGMFHYMDV

SEQ ID NO: 3345 - protein, 8 aa, Homo sapiens
  Light chain CDR3 for antibody 1673 (IGKV1-12)
QQANSFPL

SEQ ID NO: 3346 - protein, 11 aa, Homo sapiens
  Heavy chain CDR3 for antibody 1673 (IGHV3-53)
ARDLDYYGMDV

SEQ ID NO: 3347 - protein, 9 aa, Homo sapiens
  Light chain CDR3 for antibody 1674 (IGKV1-39)
QQSYSTPLT

SEQ ID NO: 3348 - protein, 13 aa, Homo sapiens
  Heavy chain CDR3 for antibody 1674 (IGHV3-53)
ARDGYCRGGSCNH

SEQ ID NO: 3349 - protein, 9 aa, Homo sapiens
  Light chain CDR3 for antibody 1675 (IGKV3-20)
QQYGSSPLT

SEQ ID NO: 3350 - protein, 19 aa, Homo sapiens
  Heavy chain CDR3 for antibody 1675 (IGHV4-31)
ARVVGHTIFGVVIIQNFDY

SEQ ID NO: 3351 - protein, 7 aa, Homo sapiens
  Light chain CDR3 for antibody 1676 (IGKV3-20)
QQYGSSL

SEQ ID NO: 3352 - protein, 11 aa, Homo sapiens
  Heavy chain CDR3 for antibody 1676 (IGHV3-53)
ARDQGNDAFDI

SEQ ID NO: 3353 - protein, 9 aa, Homo sapiens
  Light chain CDR3 for antibody 1677 (IGKV1-5)
QHYNIYPYT

SEQ ID NO: 3354 - protein, 12 aa, Homo sapiens
  Heavy chain CDR3 for antibody 1677 (IGHV3-53)
ARDLFEAGGMDV

SEQ ID NO: 3355 - protein, 9 aa, Homo sapiens
  Light chain CDR3 for antibody 1678 (IGKV1-16)
QQYNTYPHT

SEQ ID NO: 3356 - protein, 15 aa, Homo sapiens
  Heavy chain CDR3 for antibody 1678 (IGHV3-30)
AKDRGVYNWNDGMDY

SEQ ID NO: 3357 - protein, 8 aa, Homo sapiens
  Light chain CDR3 for antibody 1679 (IGKV1-12)
QQANSFPL

SEQ ID NO: 3358 - protein, 19 aa, Homo sapiens
  Heavy chain CDR3 for antibody 1679 (IGHV1-3)
ATGLGKHDYSNYVVDYMDV

SEQ ID NO: 3359 - protein, 10 aa, Homo sapiens
  Light chain CDR3 for antibody 1680 (IGKV1-39)
QQSYSNGSGT

SEQ ID NO: 3360 - protein, 16 aa, Homo sapiens
  Heavy chain CDR3 for antibody 1680 (IGHV1-58)
AAPYCSGGSCFDAFDI

SEQ ID NO: 3361 - protein, 10 aa, Homo sapiens
  Light chain CDR3 for antibody 1681 (IGKV1-9)
QQLNSYPRYT

SEQ ID NO: 3362 - protein, 20 aa, Homo sapiens
  Heavy chain CDR3 for antibody 1681 (IGHV3-11)
ASIKRDRIMITFGDYYYMDV

SEQ ID NO: 3363 - protein, 8 aa, Homo sapiens
  Light chain CDR3 for antibody 1682 (IGKV1-5)
QQYNSYSA

SEQ ID NO: 3364 - protein, 17 aa, Homo sapiens
  Heavy chain CDR3 for antibody 1682 (IGHV1-69)
ARGPARPSSGWSESWVY

SEQ ID NO: 3365 - protein, 6 aa, Homo sapiens
  Light chain CDR3 for antibody 1683 (IGKV1-5)
QQYNSY

SEQ ID NO: 3366 - protein, 13 aa, Homo sapiens
  Heavy chain CDR3 for antibody 1683 (IGHV5-51)
ARQLCGGDCAFDY

SEQ ID NO: 3367 - protein, 9 aa, Homo sapiens
  Light chain CDR3 for antibody 1684 (IGKV1-33)
QQYDNLPQT

SEQ ID NO: 3368 - protein, 20 aa, Homo sapiens
  Heavy chain CDR3 for antibody 1684 (IGHV3-30)
AKEEGKRWLQIYYYYYGMDV

SEQ ID NO: 3369 - protein, 9 aa, Homo sapiens
  Light chain CDR3 for antibody 1685 (IGKV1-39)
QQSYSTPRT

SEQ ID NO: 3370 - protein, 17 aa, Homo sapiens
  Heavy chain CDR3 for antibody 1685 (IGHV1-2)
ARVPLSHITVTPYGMDV

SEQ ID NO: 3371 - protein, 9 aa, Homo sapiens
  Light chain CDR3 for antibody 1686 (IGKV1-17)
LQHHSYPWT

SEQ ID NO: 3372 - protein, 15 aa, Homo sapiens
  Heavy chain CDR3 for antibody 1686 (IGHV1-18)
ARDVNSKVSYFYMDV

SEQ ID NO: 3373 - protein, 9 aa, Homo sapiens
  Light chain CDR3 for antibody 1687 (IGKV1-33)
QQYDNLPQT

SEQ ID NO: 3374 - protein, 11 aa, Homo sapiens
  Heavy chain CDR3 for antibody 1687 (IGHV3-53)
ARDQGNDAFDI

SEQ ID NO: 3375 - protein, 9 aa, Homo sapiens
  Light chain CDR3 for antibody 1688 (IGKV1-27)
QKYNSVSDT

SEQ ID NO: 3376 - protein, 18 aa, Homo sapiens
  Heavy chain CDR3 for antibody 1688 (IGHV3-11)
ARSYCGGDCYPESRIFDY

SEQ ID NO: 3377 - protein, 10 aa, Homo sapiens
  Light chain CDR3 for antibody 1689 (IGKV1-39)
QQSYSNGSGT

SEQ ID NO: 3378 - protein, 12 aa, Homo sapiens
  Heavy chain CDR3 for antibody 1689 (IGHV3-53)
ARPTLSRGGMDV

SEQ ID NO: 3379 - protein, 9 aa, Homo sapiens
  Light chain CDR3 for antibody 1690 (IGKV1-39)
QQSYSTPQT

SEQ ID NO: 3380 - protein, 12 aa, Homo sapiens
  Heavy chain CDR3 for antibody 1690 (IGHV3-53)
ARPTLSRGGMDV

SEQ ID NO: 3381 - protein, 8 aa, Homo sapiens
  Light chain CDR3 for antibody 1691 (IGKV1-5)
QQYNSYSA

SEQ ID NO: 3382 - protein, 19 aa, Homo sapiens
  Heavy chain CDR3 for antibody 1691 (IGHV1-3)
ATGLGKHDYSNYVVDYMDV

SEQ ID NO: 3383 - protein, 9 aa, Homo sapiens
  Light chain CDR3 for antibody 1692 (IGKV1-27)
QKYNSVSDT

SEQ ID NO: 3384 - protein, 13 aa, Homo sapiens
  Heavy chain CDR3 for antibody 1692 (IGHV5-51)
ARQLCGGDCAFDY

SEQ ID NO: 3385 - protein, 9 aa, Homo sapiens
  Light chain CDR3 for antibody 1693 (IGKV1-5)
QQSYSTPQT

SEQ ID NO: 3386 - protein, 15 aa, Homo sapiens
  Heavy chain CDR3 for antibody 1693 (IGHV1-69)
ARGQGPYSYYYYMDV

SEQ ID NO: 3387 - protein, 9 aa, Homo sapiens
  Light chain CDR3 for antibody 1694 (IGKV1-5)
QQYNSYWWT

SEQ ID NO: 3388 - protein, 12 aa, Homo sapiens
  Heavy chain CDR3 for antibody 1694 (IGHV1-24)
APTGTVGATTVT

SEQ ID NO: 3389 - protein, 9 aa, Homo sapiens
  Light chain CDR3 for antibody 1695 (IGKV1-9)
QQLNSYPLT

SEQ ID NO: 3390 - protein, 11 aa, Homo sapiens
  Heavy chain CDR3 for antibody 1695 (IGHV3-53)
ARDLDYYGMDV

SEQ ID NO: 3391 - protein, 9 aa, Homo sapiens
  Light chain CDR3 for antibody 1696 (IGKV1-39)
QQSYSTPYT

SEQ ID NO: 3392 - protein, 11 aa, Homo sapiens
  Heavy chain CDR3 for antibody 1696 (IGHV3-53)
ARDRYSYGLDY

SEQ ID NO: 3393 - protein, 9 aa, Homo sapiens
  Light chain CDR3 for antibody 1697 (IGKV1-5)
QHYNIYPYT

SEQ ID NO: 3394 - protein, 16 aa, Homo sapiens
  Heavy chain CDR3 for antibody 1697 (IGHV3-30)
AKPLFTYSYGQNYFDY

SEQ ID NO: 3395 - protein, 9 aa, Homo sapiens
  Light chain CDR3 for antibody 1698 (IGKV3-20)
QQYGSSLWT

SEQ ID NO: 3396 - protein, 19 aa, Homo sapiens
  Heavy chain CDR3 for antibody 1698 (IGHV1-69)
ARGVRYCSGGSCYGAHFQH

SEQ ID NO: 3397 - protein, 7 aa, Homo sapiens
  Light chain CDR3 for antibody 1699 (IGKV3-20)
QQYGSSL

SEQ ID NO: 3398 - protein, 17 aa, Homo sapiens
  Heavy chain CDR3 for antibody 1699 (IGHV3-9)
AKDHRYDYSNYGCYFDY

SEQ ID NO: 3399 - protein, 7 aa, Homo sapiens
  Light chain CDR3 for antibody 1700 (IGKV3-20)
QQYGSSL

SEQ ID NO: 3400 - protein, 18 aa, Homo sapiens
  Heavy chain CDR3 for antibody 1700 (IGHV1-18)
ARDLVGYCSGGSCHSGDY

SEQ ID NO: 3401 - protein, 8 aa, Homo sapiens
  Light chain CDR3 for antibody 1701 (IGKV1-12)
QQANSFPL

SEQ ID NO: 3402 - protein, 20 aa, Homo sapiens
  Heavy chain CDR3 for antibody 1701 (IGHV3-66)
AKQVGEYCSGGSCYSYYFDY

SEQ ID NO: 3403 - protein, 6 aa, Homo sapiens
  Light chain CDR3 for antibody 1702 (IGKV1-5)
QQYNSY

SEQ ID NO: 3404 - protein, 16 aa, Homo sapiens
  Heavy chain CDR3 for antibody 1702 (IGHV1-58)
AAPYCSGGSCFDAFDI

SEQ ID NO: 3405 - protein, 9 aa, Homo sapiens
  Light chain CDR3 for antibody 1703 (IGKV1-5)
QQYNGYSLT

SEQ ID NO: 3406 - protein, 16 aa, Homo sapiens
  Heavy chain CDR3 for antibody 1703 (IGHV1-2)
ARASEVTNYYSHGMDV

SEQ ID NO: 3407 - protein, 8 aa, Homo sapiens
  Light chain CDR3 for antibody 1704 (IGKV1-12)
QQANSFPL

SEQ ID NO: 3408 - protein, 18 aa, Homo sapiens
  Heavy chain CDR3 for antibody 1704 (IGHV3-15)
TTDRGFRYQLLEHDAFDI

SEQ ID NO: 3409 - protein, 9 aa, Homo sapiens
  Light chain CDR3 for antibody 1705 (IGKV1-9)
QQYNSYPLT

SEQ ID NO: 3410 - protein, 13 aa, Homo sapiens
  Heavy chain CDR3 for antibody 1705 (IGHV3-23)
AKDSRGSTDYFDY

SEQ ID NO: 3411 - protein, 9 aa, Homo sapiens
  Light chain CDR3 for antibody 1706 (IGKV1-39)
QQNLVIPRA

SEQ ID NO: 3412 - protein, 15 aa, Homo sapiens
  Heavy chain CDR3 for antibody 1706 (IGHV1-69)
ARVSVYDSSGYYHDY

SEQ ID NO: 3413 - protein, 9 aa, Homo sapiens
  Light chain CDR3 for antibody 1707 (IGKV1-5)
QQYNSYPWT

SEQ ID NO: 3414 - protein, 19 aa, Homo sapiens
  Heavy chain CDR3 for antibody 1707 (IGHV1-69)
ARGVRYCSGGSCYGAHFYH

SEQ ID NO: 3415 - protein, 8 aa, Homo sapiens
  Light chain CDR3 for antibody 1708 (IGKV1-12)
QQANSFPL

SEQ ID NO: 3416 - protein, 11 aa, Homo sapiens
  Heavy chain CDR3 for antibody 1708 (IGHV3-53)
ARDLGSSGSDY

SEQ ID NO: 3417 - protein, 7 aa, Homo sapiens
  Light chain CDR3 for antibody 1709 (IGKV1-9)
QQLNSYS

SEQ ID NO: 3418 - protein, 14 aa, Homo sapiens
  Heavy chain CDR3 for antibody 1709 (IGHV3-53)
ARLFYGGNSAGVDY

SEQ ID NO: 3419 - protein, 10 aa, Homo sapiens
  Light chain CDR3 for antibody 1710 (IGKV3-20)
QQYGSSPPWT

SEQ ID NO: 3420 - protein, 16 aa, Homo sapiens
  Heavy chain CDR3 for antibody 1710 (IGHV1-69)
AAPYCSGGSCFDAFDI

SEQ ID NO: 3421 - protein, 9 aa, Homo sapiens
  Light chain CDR3 for antibody 1711 (IGKV3-15)
QQYNNWPRT

SEQ ID NO: 3422 - protein, 15 aa, Homo sapiens
  Heavy chain CDR3 for antibody 1711 (IGHV4-61)
ARDIFEGYGDFASEY

SEQ ID NO: 3423 - protein, 8 aa, Homo sapiens
  Light chain CDR3 for antibody 1712 (IGKV4-1)
QQYYSTPS

SEQ ID NO: 3424 - protein, 19 aa, Homo sapiens
  Heavy chain CDR3 for antibody 1712 (IGHV1-3)
ATGLGKHDYSNYVVDYMDV

SEQ ID NO: 3425 - protein, 9 aa, Homo sapiens
  Light chain CDR3 for antibody 1713 (IGKV1-33)
QQYDNLPIT

SEQ ID NO: 3426 - protein, 12 aa, Homo sapiens
  Heavy chain CDR3 for antibody 1713 (IGHV3-15)
TTDSRTLYALDV

SEQ ID NO: 3427 - protein, 10 aa, Homo sapiens
  Light chain CDR3 for antibody 1714 (IGKV1-39)
QQSYNTRALT

SEQ ID NO: 3428 - protein, 15 aa, Homo sapiens
  Heavy chain CDR3 for antibody 1714 (IGHV1-69)
ARGQGPYSYYYYMDV

SEQ ID NO: 3429 - protein, 8 aa, Homo sapiens
  Light chain CDR3 for antibody 1715 (IGKV1-39)
QQYYSTPS

SEQ ID NO: 3430 - protein, 11 aa, Homo sapiens
  Heavy chain CDR3 for antibody 1715 (IGHV3-53)
ARDRYSYGLDY

SEQ ID NO: 3431 - protein, 9 aa, Homo sapiens
  Light chain CDR3 for antibody 1716 (IGKV1-39)
QQSYSTPLT

SEQ ID NO: 3432 - protein, 11 aa, Homo sapiens
  Heavy chain CDR3 for antibody 1716 (IGHV3-53)
ARDRGSGWYDY

SEQ ID NO: 3433 - protein, 7 aa, Homo sapiens
  Light chain CDR3 for antibody 1717 (IGKV3-20)
QQYGSSL

SEQ ID NO: 3434 - protein, 12 aa, Homo sapiens
  Heavy chain CDR3 for antibody 1717 (IGHV4-34)
ARGLWSLWYFDL

SEQ ID NO: 3435 - protein, 9 aa, Homo sapiens
  Light chain CDR3 for antibody 1718 (IGKV1-5)
QHYNIYPYT

SEQ ID NO: 3436 - protein, 16 aa, Homo sapiens
  Heavy chain CDR3 for antibody 1718 (IGHV3-64)
ARDSGDSPALVTWFDY

SEQ ID NO: 3437 - protein, 9 aa, Homo sapiens
  Light chain CDR3 for antibody 1719 (IGKV3-20)
QQYGSSPRT

SEQ ID NO: 3438 - protein, 12 aa, Homo sapiens
  Heavy chain CDR3 for antibody 1719 (IGHV3-53)
ARDLFEAGGMDV

SEQ ID NO: 3439 - protein, 10 aa, Homo sapiens
  Light chain CDR3 for antibody 1720 (IGKV1-39)
QQSYSTPPIT

SEQ ID NO: 3440 - protein, 20 aa, Homo sapiens
  Heavy chain CDR3 for antibody 1720 (IGHV3-30)
AKEEGKRWIQIYYYYYGMDV

SEQ ID NO: 3441 - protein, 8 aa, Homo sapiens
  Light chain CDR3 for antibody 1721 (IGKV1-39)
QQYNSYSA

SEQ ID NO: 3442 - protein, 16 aa, Homo sapiens
  Heavy chain CDR3 for antibody 1721 (IGHV3-64)
ARDSGDSPALVTWFDY

SEQ ID NO: 3443 - protein, 9 aa, Homo sapiens
  Light chain CDR3 for antibody 1722 (IGKV1-27)
QKYNSVSDT

SEQ ID NO: 3444 - protein, 15 aa, Homo sapiens
  Heavy chain CDR3 for antibody 1722 (IGHV1-69)
ARGQGPYSYYYYMDV

SEQ ID NO: 3445 - protein, 10 aa, Homo sapiens
  Light chain CDR3 for antibody 1723 (IGKV3-11)
QQRSNWPAGT

SEQ ID NO: 3446 - protein, 13 aa, Homo sapiens
  Heavy chain CDR3 for antibody 1723 (IGHV3-53)
ARDGYCRGGSCYH

SEQ ID NO: 3447 - protein, 8 aa, Homo sapiens
  Light chain CDR3 for antibody 1724 (IGKV1-12)
QQANSFPL

SEQ ID NO: 3448 - protein, 14 aa, Homo sapiens
  Heavy chain CDR3 for antibody 1724 (IGHV1-69)
AREVEMATLYGMDV

SEQ ID NO: 3449 - protein, 9 aa, Homo sapiens
  Light chain CDR3 for antibody 1725 (IGKV1-5)
QQYNSYPRT

SEQ ID NO: 3450 - protein, 17 aa, Homo sapiens
  Heavy chain CDR3 for antibody 1725 (IGHV1-69)
ARGPPLPSSGWSEIWVY

SEQ ID NO: 3451 - protein, 9 aa, Homo sapiens
  Light chain CDR3 for antibody 1726 (IGKV1-5)
QQYNSYSRT

SEQ ID NO: 3452 - protein, 11 aa, Homo sapiens
  Heavy chain CDR3 for antibody 1726 (IGHV5-51)
ARSPTTSTFDY

SEQ ID NO: 3453 - protein, 9 aa, Homo sapiens
  Light chain CDR3 for antibody 1727 (IGKV1-39)
QQNLVIPRA

SEQ ID NO: 3454 - protein, 12 aa, Homo sapiens
  Heavy chain CDR3 for antibody 1727 (IGHV3-53)
ARPTLARGGMDV

SEQ ID NO: 3455 - protein, 9 aa, Homo sapiens
  Light chain CDR3 for antibody 1728 (IGKV1-39)
QQSYSLSWT

SEQ ID NO: 3456 - protein, 13 aa, Homo sapiens
  Heavy chain CDR3 for antibody 1728 (IGHV3-15)
VTDGDSEKNWFDP

SEQ ID NO: 3457 - protein, 7 aa, Homo sapiens
  Light chain CDR3 for antibody 1729 (IGKV1-9)
QQLNSYS

SEQ ID NO: 3458 - protein, 12 aa, Homo sapiens
  Heavy chain CDR3 for antibody 1729 (IGHV3-53)
ARPTLSRGGMDV

SEQ ID NO: 3459 - protein, 9 aa, Homo sapiens
  Light chain CDR3 for antibody 1730 (IGKV1-39)
QQSYSTPRT

SEQ ID NO: 3460 - protein, 19 aa, Homo sapiens
  Heavy chain CDR3 for antibody 1730 (IGHV4-34)
ARGGRGWLQLGPPNYYFDY

SEQ ID NO: 3461 - protein, 9 aa, Homo sapiens
  Light chain CDR3 for antibody 1731 (IGKV2D-28)
MQALQTLYT

SEQ ID NO: 3462 - protein, 13 aa, Homo sapiens
  Heavy chain CDR3 for antibody 1731 (IGHV1-69)
ARQEFQEGYGMDV

SEQ ID NO: 3463 - protein, 9 aa, Homo sapiens
  Light chain CDR3 for antibody 1732 (IGKV1-16)
QQYYGYPRT

SEQ ID NO: 3464 - protein, 11 aa, Homo sapiens
  Heavy chain CDR3 for antibody 1732 (IGHV4-30-2)
RHGGGYRDIDF

SEQ ID NO: 3465 - protein, 8 aa, Homo sapiens
  Light chain CDR3 for antibody 1733 (IGKV1-5)
QQYNSYSA

SEQ ID NO: 3466 - protein, 17 aa, Homo sapiens
  Heavy chain CDR3 for antibody 1733 (IGHV1-69)
ARGPALPSSGWSEILDY

SEQ ID NO: 3467 - protein, 10 aa, Homo sapiens
  Light chain CDR3 for antibody 1734 (IGKV1-9)
QQLNSYPPYT

SEQ ID NO: 3468 - protein, 12 aa, Homo sapiens
  Heavy chain CDR3 for antibody 1734 (IGHV3-53)
ARDLFEAGGMDV

SEQ ID NO: 3469 - protein, 9 aa, Homo sapiens
  Light chain CDR3 for antibody 1735 (IGKV3-20)
QQYGSSLWT

SEQ ID NO: 3470 - protein, 13 aa, Homo sapiens
  Heavy chain CDR3 for antibody 1735 (IGHV3-64)
ARDADRAVPIFDY

SEQ ID NO: 3471 - protein, 8 aa, Homo sapiens
  Light chain CDR3 for antibody 1736 (IGKV1-9)
QQLNSYPF

SEQ ID NO: 3472 - protein, 11 aa, Homo sapiens
  Heavy chain CDR3 for antibody 1736 (IGHV3-53)
ARDIVVYGMDV

SEQ ID NO: 3473 - protein, 10 aa, Homo sapiens
  Light chain CDR3 for antibody 1737 (IGKV1-39)
QQSYSNGSGT

SEQ ID NO: 3474 - protein, 13 aa, Homo sapiens
  Heavy chain CDR3 for antibody 1737 (IGHV3-23)
AKDSRGSTDYFDY

SEQ ID NO: 3475 - protein, 8 aa, Homo sapiens
  Light chain CDR3 for antibody 1738 (IGKV1-12)
QQANSFPL

SEQ ID NO: 3476 - protein, 17 aa, Homo sapiens
  Heavy chain CDR3 for antibody 1738 (IGHV1-69)
ARGPPLPSSGWSEIWDY

SEQ ID NO: 3477 - protein, 9 aa, Homo sapiens
  Light chain CDR3 for antibody 1739 (IGKV1-27)
QKYNSVSDT

SEQ ID NO: 3478 - protein, 16 aa, Homo sapiens
  Heavy chain CDR3 for antibody 1739 (IGHV3-30)
ARDSGDSPALVTWFDY

SEQ ID NO: 3479 - protein, 10 aa, Homo sapiens
  Light chain CDR3 for antibody 1740 (IGKV1-39)
QQSYSTPPIT

SEQ ID NO: 3480 - protein, 11 aa, Homo sapiens
  Heavy chain CDR3 for antibody 1740 (IGHV3-53)
ARDRYSYGLDY

SEQ ID NO: 3481 - protein, 8 aa, Homo sapiens
  Light chain CDR3 for antibody 1741 (IGKV1-12)
QQANSFPL

SEQ ID NO: 3482 - protein, 17 aa, Homo sapiens
  Heavy chain CDR3 for antibody 1741 (IGHV5-51)
ARRQGRWYRGMFHYMDV

SEQ ID NO: 3483 - protein, 9 aa, Homo sapiens
  Light chain CDR3 for antibody 1742 (IGKV1-5)
QQYNSYPWT

SEQ ID NO: 3484 - protein, 13 aa, Homo sapiens
  Heavy chain CDR3 for antibody 1742 (IGHV3-53)
ARDGYCRGGSCYH

SEQ ID NO: 3485 - protein, 8 aa, Homo sapiens
  Light chain CDR3 for antibody 1743 (IGKV1-12)
QQANSFPL

SEQ ID NO: 3486 - protein, 12 aa, Homo sapiens
  Heavy chain CDR3 for antibody 1743 (IGHV3-53)
ARDLFEAGGMDV

SEQ ID NO: 3487 - protein, 9 aa, Homo sapiens
  Light chain CDR3 for antibody 1744 (IGKV1-9)
QQLNSDPPP

SEQ ID NO: 3488 - protein, 17 aa, Homo sapiens
  Heavy chain CDR3 for antibody 1744 (IGHV1-69)
ARGPPLPSSGWSEIWVY

SEQ ID NO: 3489 - protein, 7 aa, Homo sapiens
  Light chain CDR3 for antibody 1745 (IGKV3-20)
QQYGSSL

SEQ ID NO: 3490 - protein, 11 aa, Homo sapiens
  Heavy chain CDR3 for antibody 1745 (IGHV3-53)
GRGRWECYFDY

SEQ ID NO: 3491 - protein, 8 aa, Homo sapiens
  Light chain CDR3 for antibody 1746 (IGKV1-9)
QQLNSYPF

SEQ ID NO: 3492 - protein, 11 aa, Homo sapiens
  Heavy chain CDR3 for antibody 1746 (IGHV3-53)
ARGHWEYYFDY

SEQ ID NO: 3493 - protein, 9 aa, Homo sapiens
  Light chain CDR3 for antibody 1747 (IGKV2D-28)
MQALQTPCT

SEQ ID NO: 3494 - protein, 19 aa, Homo sapiens
  Heavy chain CDR3 for antibody 1747 (IGHV1-69)
AEGRALTLSYSSSYGAFDY

SEQ ID NO: 3495 - protein, 9 aa, Homo sapiens
  Light chain CDR3 for antibody 1748 (IGKV1-9)
QQLNSYPPL

SEQ ID NO: 3496 - protein, 11 aa, Homo sapiens
  Heavy chain CDR3 for antibody 1748 (IGHV3-53)
ARDLGPRGIDY

SEQ ID NO: 3497 - protein, 9 aa, Homo sapiens
  Light chain CDR3 for antibody 1749 (IGKV1-39)
QQSDSTPRT

SEQ ID NO: 3498 - protein, 18 aa, Homo sapiens
  Heavy chain CDR3 for antibody 1749 (IGHV1-18)
ARDSGYGGYDYWEPPLDY

SEQ ID NO: 3499 - protein, 9 aa, Homo sapiens
  Light chain CDR3 for antibody 1750 (IGKV1-39)
QQSYSTPRT

SEQ ID NO: 3500 - protein, 14 aa, Homo sapiens
  Heavy chain CDR3 for antibody 1750 (IGHV2-70)
ARTPIAAAGSPFDP

SEQ ID NO: 3501 - protein, 10 aa, Homo sapiens
  Light chain CDR3 for antibody 1751 (IGKV3-11)
QQRSIWLGYT

SEQ ID NO: 3502 - protein, 15 aa, Homo sapiens
  Heavy chain CDR3 for antibody 1751 (IGHV1-46)
ARDSEVVPAARYFQH

SEQ ID NO: 3503 - protein, 9 aa, Homo sapiens
  Light chain CDR3 for antibody 1752 (IGKV1-39)
QQSHSTPYT

SEQ ID NO: 3504 - protein, 13 aa, Homo sapiens
  Heavy chain CDR3 for antibody 1752 (IGHV4-39)
ARVPLTDFYYFDY

SEQ ID NO: 3505 - protein, 9 aa, Homo sapiens
  Light chain CDR3 for antibody 1753 (IGKV1-5)
QQYNSYSWT

SEQ ID NO: 3506 - protein, 15 aa, Homo sapiens
  Heavy chain CDR3 for antibody 1753 (IGHV1-69)
ARSVLQLERRYAFDI

SEQ ID NO: 3507 - protein, 9 aa, Homo sapiens
  Light chain CDR3 for antibody 1754 (IGKV1-39)
QQSYSSHWT

SEQ ID NO: 3508 - protein, 22 aa, Homo sapiens
  Heavy chain CDR3 for antibody 1754 (IGHV3-13)
ARGETSSTSSARARYYYYYMDV

SEQ ID NO: 3509 - protein, 10 aa, Homo sapiens
  Light chain CDR3 for antibody 1755 (IGKV1-39)
QQSYSTPPWT

SEQ ID NO: 3510 - protein, 13 aa, Homo sapiens
  Heavy chain CDR3 for antibody 1755 (IGHV3-64)
ARDWGQVTTWFDP

SEQ ID NO: 3511 - protein, 10 aa, Homo sapiens
  Light chain CDR3 for antibody 1756 (IGKV1-39)
QQSYSTPPWT

SEQ ID NO: 3512 - protein, 16 aa, Homo sapiens
  Heavy chain CDR3 for antibody 1756 (IGHV3-13)
ARGITTAAGLKYYFDY

SEQ ID NO: 3513 - protein, 9 aa, Homo sapiens
  Light chain CDR3 for antibody 1757 (IGKV1-39)
QQSHSTPWT

SEQ ID NO: 3514 - protein, 15 aa, Homo sapiens
  Heavy chain CDR3 for antibody 1757 (IGHV1-69)
ARSVLQLERRYAFDI

SEQ ID NO: 3515 - protein, 8 aa, Homo sapiens
  Light chain CDR3 for antibody 1758 (IGKV1-5)
QQYNSYNT

SEQ ID NO: 3516 - protein, 20 aa, Homo sapiens
  Heavy chain CDR3 for antibody 1758 (IGHV3-33)
AKSGGTYCSGGNCYGYYFDY

SEQ ID NO: 3517 - protein, 9 aa, Homo sapiens
  Light chain CDR3 for antibody 1759 (IGKV1-12)
QQANSFPIT

SEQ ID NO: 3518 - protein, 15 aa, Homo sapiens
  Heavy chain CDR3 for antibody 1759 (IGHV1-69)
ARSVLQLERRYAFDI

SEQ ID NO: 3519 - protein, 9 aa, Homo sapiens
  Light chain CDR3 for antibody 1760 (IGKV1-33)
QQYDNLPLT

SEQ ID NO: 3520 - protein, 21 aa, Homo sapiens
  Heavy chain CDR3 for antibody 1760 (IGHV3-33)
AKAGGGSYCGGGSCYSGYFDY

SEQ ID NO: 3521 - protein, 9 aa, Homo sapiens
  Light chain CDR3 for antibody 1761 (IGKV3-20)
QQYGSSPYT

SEQ ID NO: 3522 - protein, 19 aa, Homo sapiens
  Heavy chain CDR3 for antibody 1761 (IGHV2-26)
ARIQREVTIFGVVIFALDY

SEQ ID NO: 3523 - protein, 6 aa, Homo sapiens
  Light chain CDR3 for antibody 1762 (IGKV1-33)
QQNEGA

SEQ ID NO: 3524 - protein, 21 aa, Homo sapiens
  Heavy chain CDR3 for antibody 1762 (IGHV1-8)
ARGGWGSGGWYGKYFYYGMDV

SEQ ID NO: 3525 - protein, 9 aa, Homo sapiens
  Light chain CDR3 for antibody 1763 (IGKV1-13)
QHFNTYFLT

SEQ ID NO: 3526 - protein, 11 aa, Homo sapiens
  Heavy chain CDR3 for antibody 1763 (IGHV1-69)
ARENYGGACDY

SEQ ID NO: 3527 - protein, 10 aa, Homo sapiens
  Light chain CDR3 for antibody 1764 (IGKV3-11)
QQRSIWLGYT

SEQ ID NO: 3528 - protein, 18 aa, Homo sapiens
  Heavy chain CDR3 for antibody 1764 (IGHV1-18)
ARDSGYGGYDYWEPPLDY

SEQ ID NO: 3529 - protein, 9 aa, Homo sapiens
  Light chain CDR3 for antibody 1765 (IGKV3-20)
QQYGSSPYT

SEQ ID NO: 3530 - protein, 15 aa, Homo sapiens
  Heavy chain CDR3 for antibody 1765 (IGHV1-69)
ARSVLQLERRYAFDI

SEQ ID NO: 3531 - protein, 9 aa, Homo sapiens
  Light chain CDR3 for antibody 1766 (IGKV1-39)
QQSDSTPRT

SEQ ID NO: 3532 - protein, 11 aa, Homo sapiens
  Heavy chain CDR3 for antibody 1766 (IGHV3-53)
ARDLGPRGIDY

SEQ ID NO: 3533 - protein, 9 aa, Homo sapiens
  Light chain CDR3 for antibody 1767 (IGKV1-9)
QQLNSYPPL

SEQ ID NO: 3534 - protein, 22 aa, Homo sapiens
  Heavy chain CDR3 for antibody 1767 (IGHV3-13)
ARGETSSTSSARARYYYYYMDV

SEQ ID NO: 3535 - protein, 9 aa, Homo sapiens
  Light chain CDR3 for antibody 1768 (IGKV3-20)
QQYGSSSFT

SEQ ID NO: 3536 - protein, 10 aa, Homo sapiens
  Heavy chain CDR3 for antibody 1768 (IGHV4-28)
ATGDRVSVDY

SEQ ID NO: 3537 - protein, 9 aa, Homo sapiens
  Light chain CDR3 for antibody 1769 (IGKV4-1)
QQYYSLPLT

SEQ ID NO: 3538 - protein, 13 aa, Homo sapiens
  Heavy chain CDR3 for antibody 1769 (IGHV4-59)
TNRYGGYDSNFDS

SEQ ID NO: 3539 - protein, 10 aa, Homo sapiens
  Light chain CDR3 for antibody 1770 (IGKV3-11)
QQRSIWLGYT

SEQ ID NO: 3540 - protein, 15 aa, Homo sapiens
  Heavy chain CDR3 for antibody 1770 (IGHV1-69)
ARSVLQLERRYAFDI

SEQ ID NO: 3541 - protein, 9 aa, Homo sapiens
  Light chain CDR3 for antibody 1771 (IGKV3-11)
QQRSNWPIT

SEQ ID NO: 3542 - protein, 17 aa, Homo sapiens
  Heavy chain CDR3 for antibody 1771 (IGHV3-h)
ATAEVGTVTTYYYGMDV

SEQ ID NO: 3543 - protein, 9 aa, Homo sapiens
  Light chain CDR3 for antibody 1772 (IGKV1-13)
QQYSTYPLT

SEQ ID NO: 3544 - protein, 14 aa, Homo sapiens
  Heavy chain CDR3 for antibody 1772 (IGHV4-31)
ARDTDRSGYRGLDS

SEQ ID NO: 3545 - protein, 9 aa, Homo sapiens
  Light chain CDR3 for antibody 1773 (IGKV1-39)
QQSYSSHWT

SEQ ID NO: 3546 - protein, 11 aa, Homo sapiens
  Heavy chain CDR3 for antibody 1773 (IGHV3-53)
ARDLGPRGIDY

SEQ ID NO: 3547 - protein, 9 aa, Homo sapiens
  Light chain CDR3 for antibody 1774 (IGKV1-39)
QQSDSTPRT

SEQ ID NO: 3548 - protein, 15 aa, Homo sapiens
  Heavy chain CDR3 for antibody 1774 (IGHV1-46)
ARDSEVVPAARYFQH

SEQ ID NO: 3549 - protein, 10 aa, Homo sapiens
  Light chain CDR3 for antibody 1775 (IGKV1-39)
QQSYSTPPWT

SEQ ID NO: 3550 - protein, 11 aa, Homo sapiens
  Heavy chain CDR3 for antibody 1775 (IGHV3-53)
ARDLGPRGIDY

SEQ ID NO: 3551 - protein, 10 aa, Homo sapiens
  Light chain CDR3 for antibody 1776 (IGKV2-30)
MQGTHWPPWT

SEQ ID NO: 3552 - protein, 16 aa, Homo sapiens
  Heavy chain CDR3 for antibody 1776 (IGHV3-64)
ARDDDCSSTSCSPFDY

SEQ ID NO: 3553 - protein, 9 aa, Homo sapiens
  Light chain CDR3 for antibody 1777 (IGKV1-39)
QQSYTSPPT

SEQ ID NO: 3554 - protein, 15 aa, Homo sapiens
  Heavy chain CDR3 for antibody 1777 (IGHV1-69)
ARSVLQLERRYAFDI

SEQ ID NO: 3555 - protein, 10 aa, Homo sapiens
  Light chain CDR3 for antibody 1778 (IGKV3-11)
QQRSIWLGYT

SEQ ID NO: 3556 - protein, 11 aa, Homo sapiens
  Heavy chain CDR3 for antibody 1778 (IGHV3-53)
ARDLGPRGIDY

SEQ ID NO: 3557 - protein, 8 aa, Homo sapiens
  Light chain CDR3 for antibody 1779 (IGKV6-21)
HQTSSVYT

SEQ ID NO: 3558 - protein, 9 aa, Homo sapiens
  Heavy chain CDR3 for antibody 1779 (IGHV4-59)
ARVGGGLDY

SEQ ID NO: 3559 - protein, 9 aa, Homo sapiens
  Light chain CDR3 for antibody 1780 (IGKV1-9)
QQLNSYPPL

SEQ ID NO: 3560 - protein, 15 aa, Homo sapiens
  Heavy chain CDR3 for antibody 1780 (IGHV1-69)
ARSVLQLERRYAFDI

SEQ ID NO: 3561 - protein, 9 aa, Homo sapiens
  Light chain CDR3 for antibody 1781 (IGKV1-5)
QQYNSPPLT

SEQ ID NO: 3562 - protein, 20 aa, Homo sapiens
  Heavy chain CDR3 for antibody 1781 (IGHV1-18)
ARTQNVVRKEEHQLGSWFDP

SEQ ID NO: 3563 - protein, 9 aa, Homo sapiens
  Light chain CDR3 for antibody 1782 (IGKV1-5)
QQYNSYSWT

SEQ ID NO: 3564 - protein, 18 aa, Homo sapiens
  Heavy chain CDR3 for antibody 1782 (IGHV1-18)
ARDSGYGGYDYWEPPLDY

SEQ ID NO: 3565 - protein, 9 aa, Homo sapiens
  Light chain CDR3 for antibody 1783 (IGKV1-13)
QQFNSYPLT

SEQ ID NO: 3566 - protein, 20 aa, Homo sapiens
  Heavy chain CDR3 for antibody 1783 (IGHV4-30-2)
ARLPYYDFWSGYWTDSTGDY

SEQ ID NO: 3567 - protein, 9 aa, Homo sapiens
  Light chain CDR3 for antibody 1784 (IGKV1-9)
QQLNSYPPL

SEQ ID NO: 3568 - protein, 18 aa, Homo sapiens
  Heavy chain CDR3 for antibody 1784 (IGHV1-18)
ARDSGYGGYDYWEPPLDY

SEQ ID NO: 3569 - protein, 10 aa, Homo sapiens [sequence omitted]

SEQ ID NO: 3570 - protein, 21 aa, Homo sapiens
  Heavy chain CDR3 for antibody 1785 (IGHV4-34)
ARARWRELTIFGVVTSNWFDP

SEQ ID NO: 3571 - protein, 9 aa, Homo sapiens
  Light chain CDR3 for antibody 1786 (IGKV1-39)
QQSYTSPPT

SEQ ID NO: 3572 - protein, 14 aa, Homo sapiens
  Heavy chain CDR3 for antibody 1786 (IGHV1-18)
ARDFADWGYPLFDS

SEQ ID NO: 3573 - protein, 9 aa, Homo sapiens
  Light chain CDR3 for antibody 1787 (IGKV1-9)
QQLNSYPPL

SEQ ID NO: 3574 - protein, 13 aa, Homo sapiens
  Heavy chain CDR3 for antibody 1787 (IGHV3-64)
ARDWGQVTTWFDP

SEQ ID NO: 3575 - protein, 9 aa, Homo sapiens
  Light chain CDR3 for antibody 1788 (IGKV1-5)
QQYNSYSWT

SEQ ID NO: 3576 - protein, 15 aa, Homo sapiens
  Heavy chain CDR3 for antibody 1788 (IGHV1-46)
ARDSEVVPAARYFQH

SEQ ID NO: 3577 - protein, 10 aa, Homo sapiens
  Light chain CDR3 for antibody 1789 (IGKV3-11)
QQRSIWLGYT

SEQ ID NO: 3578 - protein, 13 aa, Homo sapiens
  Heavy chain CDR3 for antibody 1789 (IGHV4-39)
ARVPLTDFYYFDY

SEQ ID NO: 3579 - protein, 9 aa, Homo sapiens
  Light chain CDR3 for antibody 1790 (IGKV1-39)
QQSYSSHWT

SEQ ID NO: 3580 - protein, 14 aa, Homo sapiens
  Heavy chain CDR3 for antibody 1790 (IGHV2-70)
ARTPIAAAGSPFDP

SEQ ID NO: 3581 - protein, 10 aa, Homo sapiens
  Light chain CDR3 for antibody 1791 (IGKV3-11)
QQRSIWLGYT

SEQ ID NO: 3582 - protein, 14 aa, Homo sapiens
  Heavy chain CDR3 for antibody 1791 (IGHV2-70)
ARTPIAAAGSPFDP

SEQ ID NO: 3583 - protein, 10 aa, Homo sapiens
  Light chain CDR3 for antibody 1792 (IGKV1-5)
QQYKSNDPYT

SEQ ID NO: 3584 - protein, 10 aa, Homo sapiens
  Heavy chain CDR3 for antibody 1792 (IGHV3-21)
ARALSAAESY

SEQ ID NO: 3585 - protein, 9 aa, Homo sapiens
  Light chain CDR3 for antibody 1793 (IGKV1-9)
QQLNSYPPL

SEQ ID NO: 3586 - protein, 14 aa, Homo sapiens
  Heavy chain CDR3 for antibody 1793 (IGHV2-70)
ARTPIAAAGSPFDP

SEQ ID NO: 3587 - protein, 9 aa, Homo sapiens
  Light chain CDR3 for antibody 1794 (IGKV1-5)
QQYNSYSWT

SEQ ID NO: 3588 - protein, 11 aa, Homo sapiens
  Heavy chain CDR3 for antibody 1794 (IGHV3-53)
ARDLGPRGIDY

SEQ ID NO: 3589 - protein, 9 aa, Homo sapiens
  Light chain CDR3 for antibody 1795 (IGKV1-39)
QQSYSSHWT

SEQ ID NO: 3590 - protein, 18 aa, Homo sapiens
  Heavy chain CDR3 for antibody 1795 (IGHV1-18)
ARDSGYGGYDYWEPPLDY

SEQ ID NO: 3591 - protein, 9 aa, Homo sapiens
  Light chain CDR3 for antibody 1796 (IGKV1-9)
QQLNSYPPL

SEQ ID NO: 3592 - protein, 13 aa, Homo sapiens
  Heavy chain CDR3 for antibody 1796 (IGHV4-39)
ARVPLTDFYYFDY

SEQ ID NO: 3593 - protein, 10 aa, Homo sapiens
  Light chain CDR3 for antibody 1797 (IGKV3-20)
QQYGSSPPIT

SEQ ID NO: 3594 - protein, 20 aa, Homo sapiens
  Heavy chain CDR3 for antibody 1797 (IGHV2-26)
ARIGRERLIFGVVYYYYMDV

SEQ ID NO: 3595 - protein, 10 aa, Homo sapiens
  Light chain CDR3 for antibody 1798 (IGKV1-39)
QQSYSTPPWT

SEQ ID NO: 3596 - protein, 22 aa, Homo sapiens
  Heavy chain CDR3 for antibody 1798 (IGHV3-13)
ARGETSSTSSARARYYYYYMDV

SEQ ID NO: 3597 - protein, 9 aa, Homo sapiens
  Light chain CDR3 for antibody 1799 (IGKV1-5)
QQYNSYSWT

SEQ ID NO: 3598 - protein, 14 aa, Homo sapiens
  Heavy chain CDR3 for antibody 1799 (IGHV2-70)
ARTPIAAAGSPFDP

SEQ ID NO: 3599 - protein, 9 aa, Homo sapiens
  Light chain CDR3 for antibody 1800 (IGKV1-9)
QQLNSYPPL

SEQ ID NO: 3600 - protein, 16 aa, Homo sapiens
  Heavy chain CDR3 for antibody 1800 (IGHV3-13)
ARGITTAAGLKYYFDY

SEQ ID NO: 3601 - protein, 9 aa, Homo sapiens
  Light chain CDR3 for antibody 1801 (IGKV1-39)
QQSYSSHWT

SEQ ID NO: 3602 - protein, 15 aa, Homo sapiens
  Heavy chain CDR3 for antibody 1801 (IGHV1-69)
ARSVLQLERRYAFDI

SEQ ID NO: 3603 - protein, 9 aa, Homo sapiens
  Light chain CDR3 for antibody 1802 (IGKV1-39)
QQSYSSHWT

SEQ ID NO: 3604 - protein, 16 aa, Homo sapiens
  Heavy chain CDR3 for antibody 1802 (IGHV3-13)
ARGITTAAGLKYYFDY

SEQ ID NO: 3605 - protein, 11 aa, Homo sapiens
  Light chain CDR3 for antibody 1803 (IGKV3-15)
QQYNNWPPGVT

SEQ ID NO: 3606 - protein, 16 aa, Homo sapiens
  Heavy chain CDR3 for antibody 1803 (IGHV3-9)
AKGGSIAALFYQPFDY

SEQ ID NO: 3607 - protein, 10 aa, Homo sapiens
  Light chain CDR3 for antibody 1804 (IGKV1-39)
QQSYSTPPWT

SEQ ID NO: 3608 - protein, 18 aa, Homo sapiens
  Heavy chain CDR3 for antibody 1804 (IGHV1-18)
ARDSGYGGYDYWEPPLDY

SEQ ID NO: 3609 - protein, 10 aa, Homo sapiens
  Light chain CDR3 for antibody 1805 (IGKV1-39)
QQSYSTPPWT

SEQ ID NO: 3610 - protein, 15 aa, Homo sapiens
  Heavy chain CDR3 for antibody 1805 (IGHV1-69)
ARSVLQLERRYAFDI

SEQ ID NO: 3611 - protein, 8 aa, Homo sapiens
  Light chain CDR3 for antibody 1806 (IGKV1-39)
QQSYSSRS

SEQ ID NO: 3612 - protein, 9 aa, Homo sapiens
  Heavy chain CDR3 for antibody 1806 (IGHV1-46)
ARGADAFDI

SEQ ID NO: 3613 - protein, 9 aa, Homo sapiens
  Light chain CDR3 for antibody 1807 (IGKV1-39)
QQSYSSHWT

SEQ ID NO: 3614 - protein, 13 aa, Homo sapiens
  Heavy chain CDR3 for antibody 1807 (IGHV4-39)
ARVPLTDFYYFDY

SEQ ID NO: 3615 - protein, 10 aa, Homo sapiens
  Light chain CDR3 for antibody 1808 (IGKV1-33)
QQYDNLPVLT

SEQ ID NO: 3616 - protein, 20 aa, Homo sapiens
  Heavy chain CDR3 for antibody 1808 (IGHV3-11)
AKDLSWYCGAGSCSGGTFDY

SEQ ID NO: 3617 - protein, 10 aa, Homo sapiens
  Light chain CDR3 for antibody 1809 (IGKV1-5)
QQYKSNDPYT

SEQ ID NO: 3618 - protein, 16 aa, Homo sapiens
  Heavy chain CDR3 for antibody 1809 (IGHV1-18)
ARGLRYFDWLFSSMDV

SEQ ID NO: 3619 - protein, 9 aa, Homo sapiens
  Light chain CDR3 for antibody 1810 (IGKV1-39)
QQSYSTPYT

SEQ ID NO: 3620 - protein, 17 aa, Homo sapiens
  Heavy chain CDR3 for antibody 1810 (IGHV1-69)
ARGGYSSGHTSGWYFDL

SEQ ID NO: 3621 - protein, 9 aa, Homo sapiens
  Light chain CDR3 for antibody 1811 (IGKV1-9)
QQLNSYPPL

SEQ ID NO: 3622 - protein, 15 aa, Homo sapiens
  Heavy chain CDR3 for antibody 1811 (IGHV1-46)
ARDSEVVPAARYFQH

SEQ ID NO: 3623 - protein, 9 aa, Homo sapiens
  Light chain CDR3 for antibody 1812 (IGKV1-39)
QQSYSSHWT

SEQ ID NO: 3624 - protein, 21 aa, Homo sapiens
  Heavy chain CDR3 for antibody 1812 (IGHV3-13)
ARGETSSTSSARARYYYYMDV

SEQ ID NO: 3625 - protein, 9 aa, Homo sapiens
  Light chain CDR3 for antibody 1813 (IGKV1-17)
LQHNSYPLT

SEQ ID NO: 3626 - protein, 12 aa, Homo sapiens
  Heavy chain CDR3 for antibody 1813 (IGHV4-39)
ARRGETSEYFHL

SEQ ID NO: 3627 - protein, 9 aa, Homo sapiens
  Light chain CDR3 for antibody 1814 (IGKV3-20)
QQANSFPRT

SEQ ID NO: 3628 - protein, 18 aa, Homo sapiens
  Heavy chain CDR3 for antibody 1814 (IGHV4-31)
ARESEYYYDSSGWGAFDI

SEQ ID NO: 3629 - protein, 9 aa, Homo sapiens
  Light chain CDR3 for antibody 1815 (IGKV3-20)
QQYGSSSWT

SEQ ID NO: 3630 - protein, 16 aa, Homo sapiens
  Heavy chain CDR3 for antibody 1815 (IGHV3-33)
AKEEYCSTTSCHCLDY

SEQ ID NO: 3631 - protein, 10 aa, Homo sapiens
  Light chain CDR3 for antibody 1816 (IGKV3-11)
QQRSIWLGYT

SEQ ID NO: 3632 - protein, 22 aa, Homo sapiens
  Heavy chain CDR3 for antibody 1816 (IGHV3-13)
ARGETSSTSSARARYYYYYMDV

SEQ ID NO: 3633 - protein, 9 aa, Homo sapiens
  Light chain CDR3 for antibody 1817 (IGKV1-39)
QQSDSTPRT

SEQ ID NO: 3634 - protein, 14 aa, Homo sapiens
  Heavy chain CDR3 for antibody 1817 (IGHV1-69)
ARMYSGYYYYGMDV

SEQ ID NO: 3635 - protein, 9 aa, Homo sapiens
  Light chain CDR3 for antibody 1818 (IGKV1-12)
QQANSFPIT

SEQ ID NO: 3636 - protein, 18 aa, Homo sapiens
  Heavy chain CDR3 for antibody 1818 (IGHV1-18)
ARDSGYGGYDYWEPPLDY

SEQ ID NO: 3637 - protein, 9 aa, Homo sapiens
  Light chain CDR3 for antibody 1819 (IGKV1-13)
QQYNSYPLT

SEQ ID NO: 3638 - protein, 20 aa, Homo sapiens
  Heavy chain CDR3 for antibody 1819 (IGHV4-59)
ARVSSIAAREWFHYYYYMDV

SEQ ID NO: 3639 - protein, 9 aa, Homo sapiens
  Light chain CDR3 for antibody 1820 (IGKV1-39)
QQSYSSHWT

SEQ ID NO: 3640 - protein, 15 aa, Homo sapiens
  Heavy chain CDR3 for antibody 1820 (IGHV1-46)
ARDSEVVPAARYFQH

SEQ ID NO: 3641 - protein, 8 aa, Homo sapiens
  Light chain CDR3 for antibody 1821 (IGKV1-13)
QQSYSTLT

SEQ ID NO: 3642 - protein, 11 aa, Homo sapiens
  Heavy chain CDR3 for antibody 1821 (IGHV1-69)
ARENYGGACDY

SEQ ID NO: 3643 - protein, 9 aa, Homo sapiens
  Light chain CDR3 for antibody 1822 (IGKV3-20)
QQLKTYPFT

SEQ ID NO: 3644 - protein, 19 aa, Homo sapiens
  Heavy chain CDR3 for antibody 1822 (IGHV1-46)
ASVRWSKLGGVYYYYGLDV

SEQ ID NO: 3645 - protein, 9 aa, Homo sapiens
  Light chain CDR3 for antibody 1823 (IGKV1-33)
QQYDNLPLT

SEQ ID NO: 3646 - protein, 11 aa, Homo sapiens
  Heavy chain CDR3 for antibody 1823 (IGHV3-53)
ARDLGPRGIDY

SEQ ID NO: 3647 - protein, 9 aa, Homo sapiens
  Light chain CDR3 for antibody 1824 (IGKV1-39)
QQSYSTPRT

SEQ ID NO: 3648 - protein, 10 aa, Homo sapiens
  Heavy chain CDR3 for antibody 1824 (IGHV3-21)
ARALSAAESY

SEQ ID NO: 3649 - protein, 8 aa, Homo sapiens
  Light chain CDR3 for antibody 1825 (IGKV3-20)
QQYGSSLT

SEQ ID NO: 3650 - protein, 26 aa, Homo sapiens
  Heavy chain CDR3 for antibody 1825 (IGHV1-69)
AREGNVDYDFWSGYSRPRYYYYYMDV

SEQ ID NO: 3651 - protein, 9 aa, Homo sapiens
  Light chain CDR3 for antibody 1826 (IGKV1-39)
KQTRSSPRT

SEQ ID NO: 3652 - protein, 21 aa, Homo sapiens
  Heavy chain CDR3 for antibody 1826 (IGHV4-30-4)
ARGQTSARIPIFGVVLKHVDY

SEQ ID NO: 3653 - protein, 9 aa, Homo sapiens
  Light chain CDR3 for antibody 1827 (IGKV3-20)
QQYGSSPYT

SEQ ID NO: 3654 - protein, 14 aa, Homo sapiens
  Heavy chain CDR3 for antibody 1827 (IGHV2-70)
ARTPIAAAGSPFDP

SEQ ID NO: 3655 - protein, 9 aa, Homo sapiens
  Light chain CDR3 for antibody 1828 (IGKV1-39)
QQSDSTPRT

SEQ ID NO: 3656 - protein, 13 aa, Homo sapiens
  Heavy chain CDR3 for antibody 1828 (IGHV3-64)
ARDWGQVTTWFDP

SEQ ID NO: 3657 - protein, 9 aa, Homo sapiens
  Light chain CDR3 for antibody 1829 (IGKV3-11)
QQRSNWPLS

SEQ ID NO: 3658 - protein, 16 aa, Homo sapiens
  Heavy chain CDR3 for antibody 1829 (IGHV3-33)
AKEEYCSTTSCHCLDY

SEQ ID NO: 3659 - protein, 11 aa, Homo sapiens
  Light chain CDR3 for antibody 1830 (IGKV1-12)
QQANTFPPSLT

SEQ ID NO: 3660 - protein, 11 aa, Homo sapiens
  Heavy chain CDR3 for antibody 1830 (IGHV4-59)
ARVITLTHMDL

SEQ ID NO: 3661 - protein, 9 aa, Homo sapiens
  Light chain CDR3 for antibody 1831 (IGKV1-5)
QQYNSYSWT

SEQ ID NO: 3662 - protein, 22 aa, Homo sapiens
  Heavy chain CDR3 for antibody 1831 (IGHV3-13)
ARGETSSTSSARARYYYYYMDV

SEQ ID NO: 3663 - protein, 9 aa, Homo sapiens
  Light chain CDR3 for antibody 1832 (IGKV1-39)
QQSYSSHWT

SEQ ID NO: 3664 - protein, 13 aa, Homo sapiens
  Heavy chain CDR3 for antibody 1832 (IGHV3-64)
ARDWGQVTTWFDP

SEQ ID NO: 3665 - protein, 9 aa, Homo sapiens
  Light chain CDR3 for antibody 1833 (IGKV3-20)
QQYGSSPYT

SEQ ID NO: 3666 - protein, 15 aa, Homo sapiens
  Heavy chain CDR3 for antibody 1833 (IGHV1-46)
ARDSEVVPAARYFQH

SEQ ID NO: 3667 - protein, 10 aa, Homo sapiens
  Light chain CDR3 for antibody 1834 (IGKV1-39)
QQSYSTPPWT

SEQ ID NO: 3668 - protein, 14 aa, Homo sapiens
  Heavy chain CDR3 for antibody 1834 (IGHV2-70)
ARTPIAAAGSPFDP

SEQ ID NO: 3669 - protein, 10 aa, Homo sapiens [sequence omitted]

SEQ ID NO: 3670 - protein, 15 aa, Homo sapiens
  Heavy chain CDR3 for antibody 1835 (IGHV1-69)
ARSVLQLERRYAFDI

SEQ ID NO: 3671 - protein, 9 aa, Homo sapiens
  Light chain CDR3 for antibody 1836 (IGKV1-9)
QQLNSYPPL

SEQ ID NO: 3672 - protein, 10 aa, Homo sapiens
  Heavy chain CDR3 for antibody 1836 (IGHV3-21)
ARALSAAESY

SEQ ID NO: 3673 - protein, 11 aa, Homo sapiens
  Light chain CDR3 for antibody 1837 (IGKV2-30)
MQGTHWPLMYT

SEQ ID NO: 3674 - protein, 13 aa, Homo sapiens
  Heavy chain CDR3 for antibody 1837 (IGHV1-69)
ARHYDSSGNPRDY

SEQ ID NO: 3675 - protein, 9 aa, Homo sapiens
  Light chain CDR3 for antibody 1838 (IGKV1-13)
QQFNSYPIT

SEQ ID NO: 3676 - protein, 13 aa, Homo sapiens
  Heavy chain CDR3 for antibody 1838 (IGHV1-18)
ARDLGYSSSSGDY

SEQ ID NO: 3677 - protein, 11 aa, Homo sapiens
  Light chain CDR3 for antibody 1839 (IGKV1-12)
QQANSFPPGLT

SEQ ID NO: 3678 - protein, 15 aa, Homo sapiens
  Heavy chain CDR3 for antibody 1839 (IGHV4-31)
ARGGGSYYDRGAMGY

SEQ ID NO: 3679 - protein, 9 aa, Homo sapiens
  Light chain CDR3 for antibody 1840 (IGKV1-12)
QQANSFPIT

SEQ ID NO: 3680 - protein, 13 aa, Homo sapiens
  Heavy chain CDR3 for antibody 1840 (IGHV3-21)
TRSYWTGYNWFDP

SEQ ID NO: 3681 - protein, 10 aa, Homo sapiens
  Light chain CDR3 for antibody 1841 (IGKV1-39)
QQSYSTPPWT

SEQ ID NO: 3682 - protein, 13 aa, Homo sapiens
  Heavy chain CDR3 for antibody 1841 (IGHV4-39)
ARVPLTDFYYFDY

SEQ ID NO: 3683 - protein, 8 aa, Homo sapiens
  Light chain CDR3 for antibody 1842 (IGKV1-5)
QQYNSYNT

SEQ ID NO: 3684 - protein, 11 aa, Homo sapiens
  Heavy chain CDR3 for antibody 1842 (IGHV3-53)
ARDLGPRGIDY

SEQ ID NO: 3685 - protein, 9 aa, Homo sapiens
  Light chain CDR3 for antibody 1843 (IGKV1-9)
QQLNSYPPL

SEQ ID NO: 3686 - protein, 13 aa, Homo sapiens
  Heavy chain CDR3 for antibody 1843 (IGHV3-64)
ARGAGNFLYWFDP

SEQ ID NO: 3687 - protein, 6 aa, Homo sapiens
  Light chain CDR3 for antibody 1844 (IGKV1-33)
QQNEGA

SEQ ID NO: 3688 - protein, 18 aa, Homo sapiens
  Heavy chain CDR3 for antibody 1844 (IGHV1-18)
ARDSGYGGYDYWEPPLDY

SEQ ID NO: 3689 - protein, 9 aa, Homo sapiens
  Light chain CDR3 for antibody 1845 (IGKV1-13)
QQYNSYPLT

SEQ ID NO: 3690 - protein, 16 aa, Homo sapiens
  Heavy chain CDR3 for antibody 1845 (IGHV4-34)
ARDPRTIFGVVREFDI

SEQ ID NO: 3691 - protein, 9 aa, Homo sapiens
  Light chain CDR3 for antibody 1846 (IGKV1-39)
QQSDSTPRT

SEQ ID NO: 3692 - protein, 16 aa, Homo sapiens
  Heavy chain CDR3 for antibody 1846 (IGHV3-13)
ARGITTAAGLKYYFDY

SEQ ID NO: 3693 - protein, 8 aa, Homo sapiens
  Light chain CDR3 for antibody 1847 (IGKV1-5)
QQYRSFWT

SEQ ID NO: 3694 - protein, 15 aa, Homo sapiens
  Heavy chain CDR3 for antibody 1847 (IGHV3-48)
VRDHMSGQQLLRPDC

SEQ ID NO: 3695 - protein, 9 aa, Homo sapiens
  Light chain CDR3 for antibody 1848 (IGKV1-13)
QQYDNLLLT

SEQ ID NO: 3696 - protein, 23 aa, Homo sapiens
  Heavy chain CDR3 for antibody 1848 (IGHV4-34)
ARASISIFGVAIIPIGYSHYMDV

SEQ ID NO: 3697 - protein, 9 aa, Homo sapiens
  Light chain CDR3 for antibody 1849 (IGKV1-5)
QQYNSYSWT

SEQ ID NO: 3698 - protein, 13 aa, Homo sapiens
  Heavy chain CDR3 for antibody 1849 (IGHV4-39)
ARVPLTDFYYFDY

SEQ ID NO: 3699 - protein, 8 aa, Homo sapiens
  Light chain CDR3 for antibody 1850 (IGKV1-5)
QQYNSYNT

SEQ ID NO: 3700 - protein, 22 aa, Homo sapiens
  Heavy chain CDR3 for antibody 1850 (IGHV3-13)
ARGETSSTSSARARYYYYYMDV

SEQ ID NO: 3701 - protein, 9 aa, Homo sapiens
  Light chain CDR3 for antibody 1851 (IGKV1-9)
QQLNSYPLT

SEQ ID NO: 3702 - protein, 11 aa, Homo sapiens
  Heavy chain CDR3 for antibody 1851 (IGHV3-15)
TTDQAAVWFDP

SEQ ID NO: 3703 - protein, 9 aa, Homo sapiens
  Light chain CDR3 for antibody 1852 (IGKV1-33)
QQYQDRPWT

SEQ ID NO: 3704 - protein, 10 aa, Homo sapiens
  Heavy chain CDR3 for antibody 1852 (IGHV3-21)
ARALSAAESY

SEQ ID NO: 3705 - protein, 10 aa, Homo sapiens
  Light chain CDR3 for antibody 1853 (IGKV1-39)
QQSYSTPPWT

SEQ ID NO: 3706 - protein, 15 aa, Homo sapiens
  Heavy chain CDR3 for antibody 1853 (IGHV1-46)
ARDSEVVPAARYFQH

SEQ ID NO: 3707 - protein, 10 aa, Homo sapiens
  Light chain CDR3 for antibody 1854 (IGKV3-11)
QQRSIWLGYT

SEQ ID NO: 3708 - protein, 13 aa, Homo sapiens
  Heavy chain CDR3 for antibody 1854 (IGHV3-64)
ARDWGQVTTWFDP

SEQ ID NO: 3709 - protein, 6 aa, Homo sapiens
  Light chain CDR3 for antibody 1855 (IGKV1-33)
QQNEGA

SEQ ID NO: 3710 - protein, 15 aa, Homo sapiens
  Heavy chain CDR3 for antibody 1855 (IGHV1-69)
ARSVLQLERRYAFDI

SEQ ID NO: 3711 - protein, 10 aa, Homo sapiens
  Light chain CDR3 for antibody 1856 (IGKV3-11)
QQRGIWLGYT

SEQ ID NO: 3712 - protein, 15 aa, Homo sapiens
  Heavy chain CDR3 for antibody 1856 (IGHV1-46)
ARDSEVVPAARYFEH

SEQ ID NO: 3713 - protein, 8 aa, Homo sapiens
  Light chain CDR3 for antibody 1857 (IGKV1-9)
QQLNSYRT

SEQ ID NO: 3714 - protein, 17 aa, Homo sapiens
  Heavy chain CDR3 for antibody 1857 (IGHV3-9)
AKDLIKPGIAVAGPFDY

SEQ ID NO: 3715 - protein, 9 aa, Homo sapiens
  Light chain CDR3 for antibody 1858 (IGKV1-33)
QQYDNLPLT

SEQ ID NO: 3716 - protein, 22 aa, Homo sapiens
  Heavy chain CDR3 for antibody 1858 (IGHV3-13)
ARGETSSTSSARARYYYYYMDV

SEQ ID NO: 3717 - protein, 9 aa, Homo sapiens
  Light chain CDR3 for antibody 1859 (IGKV1-9)
QQLNSYPPL

SEQ ID NO: 3718 - protein, 20 aa, Homo sapiens
  Heavy chain CDR3 for antibody 1859 (IGHV3-33)
AKSGGTYCSGGNCYGYYFDY

SEQ ID NO: 3719 - protein, 10 aa, Homo sapiens
  Light chain CDR3 for antibody 1860 (IGKV3-11)
QQRSIWLGYT

SEQ ID NO: 3720 - protein, 10 aa, Homo sapiens
  Heavy chain CDR3 for antibody 1860 (IGHV3-21)
ARALSAAESY

SEQ ID NO: 3721 - protein, 9 aa, Homo sapiens
  Light chain CDR3 for antibody 1861 (IGKV3-15)
QQYNNWPLT

SEQ ID NO: 3722 - protein, 11 aa, Homo sapiens
  Heavy chain CDR3 for antibody 1861 (IGHV1-69)
ASGGSSYGSDY

SEQ ID NO: 3723 - protein, 10 aa, Homo sapiens
  Light chain CDR3 for antibody 1862 (IGKV1-39)
QQSYSSPALS

SEQ ID NO: 3724 - protein, 10 aa, Homo sapiens
  Heavy chain CDR3 for antibody 1862 (IGHV1-69)
ARDLGNYGAY

SEQ ID NO: 3725 - protein, 9 aa, Homo sapiens
  Light chain CDR3 for antibody 1863 (IGKV1-39)
QQSYSSPWT

SEQ ID NO: 3726 - protein, 16 aa, Homo sapiens
  Heavy chain CDR3 for antibody 1863 (IGHV1-69)
ATVPLGYSGFAFFFDY

SEQ ID NO: 3727 - protein, 9 aa, Homo sapiens
  Light chain CDR3 for antibody 1864 (IGKV1-39)
QQSYSSHWT

SEQ ID NO: 3728 - protein, 10 aa, Homo sapiens
  Heavy chain CDR3 for antibody 1864 (IGHV3-21)
ARALSAAESY

SEQ ID NO: 3729 - protein, 10 aa, Homo sapiens
  Light chain CDR3 for antibody 1865 (IGKV2-30)
MQGTHWPPWT

SEQ ID NO: 3730 - protein, 11 aa, Homo sapiens
  Heavy chain CDR3 for antibody 1865 (IGHV3-53)
ARDLGPRGIDY

SEQ ID NO: 3731 - protein, 9 aa, Homo sapiens
  Light chain CDR3 for antibody 1866 (IGKV3-20)
QQYGSSPYT

SEQ ID NO: 3732 - protein, 13 aa, Homo sapiens
  Heavy chain CDR3 for antibody 1866 (IGHV4-39)
ARVPLTDFYYFDY

SEQ ID NO: 3733 - protein, 9 aa, Homo sapiens
  Light chain CDR3 for antibody 1867 (IGKV1-12)
QQANSFPIT

SEQ ID NO: 3734 - protein, 15 aa, Homo sapiens
  Heavy chain CDR3 for antibody 1867 (IGHV1-46)
ARDSEVVPAARYFQH

SEQ ID NO: 3735 - protein, 10 aa, Homo sapiens
  Light chain CDR3 for antibody 1868 (IGKV3-15)
HQYNKWPPFT

SEQ ID NO: 3736 - protein, 19 aa, Homo sapiens
  Heavy chain CDR3 for antibody 1868 (IGHV3-21)
ARGNQIAAVAAAIPNWFDP

SEQ ID NO: 3737 - protein, 9 aa, Homo sapiens
  Light chain CDR3 for antibody 1869 (IGKV1-39)
QQSDSTPRT

SEQ ID NO: 3738 - protein, 11 aa, Homo sapiens
  Heavy chain CDR3 for antibody 1869 (IGHV1-69)
ARENYGGACDY

SEQ ID NO: 3739 - protein, 9 aa, Homo sapiens
  Light chain CDR3 for antibody 1870 (IGKV1-9)
QQLNSYPPL

SEQ ID NO: 3740 - protein, 21 aa, Homo sapiens
  Heavy chain CDR3 for antibody 1870 (IGHV1-8)
ARGGWGSGGWYGKYFYYGMDV

SEQ ID NO: 3741 - protein, 9 aa, Homo sapiens
  Light chain CDR3 for antibody 1871 (IGKV1-39)
QQSDSTPRT

SEQ ID NO: 3742 - protein, 20 aa, Homo sapiens
  Heavy chain CDR3 for antibody 1871 (IGHV3-33)
AKSGGTYCSGGNCYGYYFDY

SEQ ID NO: 3743 - protein, 9 aa, Homo sapiens
  Light chain CDR3 for antibody 1872 (IGKV1-17)
LQHNSYPLT

SEQ ID NO: 3744 - protein, 14 aa, Homo sapiens
  Heavy chain CDR3 for antibody 1872 (IGHV4-39)
ARLTRGYSYGTIDY

SEQ ID NO: 3745 - protein, 9 aa, Homo sapiens
  Light chain CDR3 for antibody 1873 (IGKV1-39)
QQSYSTPYT

SEQ ID NO: 3746 - protein, 17 aa, Homo sapiens
  Heavy chain CDR3 for antibody 1873 (IGHV1-2)
ARDDCSGGSCYSAWFDP

SEQ ID NO: 3747 - protein, 9 aa, Homo sapiens
  Light chain CDR3 for antibody 1874 (IGKV3-20)
QQYGSSPYT

SEQ ID NO: 3748 - protein, 18 aa, Homo sapiens
  Heavy chain CDR3 for antibody 1874 (IGHV1-18)
ARDSGYGGYDYWEPPLDY

SEQ ID NO: 3749 - protein, 9 aa, Homo sapiens
  Light chain CDR3 for antibody 1875 (IGKV1-33)
QQYDNLPLT

SEQ ID NO: 3750 - protein, 14 aa, Homo sapiens
  Heavy chain CDR3 for antibody 1875 (IGHV2-70)
ARTPIAAAGSPFDP

SEQ ID NO: 3751 - protein, 10 aa, Homo sapiens
  Light chain CDR3 for antibody 1876 (IGKV3-11)
QQRSIWLGYT

SEQ ID NO: 3752 - protein, 21 aa, Homo sapiens
  Heavy chain CDR3 for antibody 1876 (IGHV3-33)
AKAGGGSYCGGGSCYSGYFDY

SEQ ID NO: 3753 - protein, 9 aa, Homo sapiens
  Light chain CDR3 for antibody 1877 (IGKV1-39)
QQSYSTPPT

SEQ ID NO: 3754 - protein, 13 aa, Homo sapiens
  Heavy chain CDR3 for antibody 1877 (IGHV4-30-2)
ASSVDTAMGDFDY

SEQ ID NO: 3755 - protein, 9 aa, Homo sapiens
  Light chain CDR3 for antibody 1878 (IGKV1-33)
QQYDNLPLT

SEQ ID NO: 3756 - protein, 10 aa, Homo sapiens
  Heavy chain CDR3 for antibody 1878 (IGHV3-21)
ARALSAAESY

SEQ ID NO: 3757 - protein, 9 aa, Homo sapiens
  Light chain CDR3 for antibody 1879 (IGKV1-5)
QQYNSPPLT

SEQ ID NO: 3758 - protein, 18 aa, Homo sapiens
  Heavy chain CDR3 for antibody 1879 (IGHV1-18)
ARDSGYGGYDYWEPPLDY

SEQ ID NO: 3759 - protein, 9 aa, Homo sapiens
  Light chain CDR3 for antibody 1880 (IGKV1-12)
QQANSFPIT

SEQ ID NO: 3760 - protein, 14 aa, Homo sapiens
  Heavy chain CDR3 for antibody 1880 (IGHV2-70)
ARTPIAAAGSPFDP

SEQ ID NO: 3761 - protein, 9 aa, Homo sapiens
  Light chain CDR3 for antibody 1881 (IGKV1-9)
QQLNSYPPL

SEQ ID NO: 3762 - protein, 21 aa, Homo sapiens
  Heavy chain CDR3 for antibody 1881 (IGHV3-33)
AKAGGGSYCGGGSCYSGYFDY

SEQ ID NO: 3763 - protein, 9 aa, Homo sapiens
  Light chain CDR3 for antibody 1882 (IGKV1-13)
QQYSTYPLT

SEQ ID NO: 3764 - protein, 14 aa, Homo sapiens
  Heavy chain CDR3 for antibody 1882 (IGHV1-69)
ARMYSGYYYYGMDV

SEQ ID NO: 3765 - protein, 9 aa, Homo sapiens
  Light chain CDR3 for antibody 1883 (IGKV1-9)
QQLNSYPPL

SEQ ID NO: 3766 - protein, 14 aa, Homo sapiens
  Heavy chain CDR3 for antibody 1883 (IGHV1-69)
ARMYSGYYYYGMDV

SEQ ID NO: 3767 - protein, 10 aa, Homo sapiens
  Light chain CDR3 for antibody 1884 (IGKV1-5)
QQYKSNDPYT

SEQ ID NO: 3768 - protein, 19 aa, Homo sapiens
  Heavy chain CDR3 for antibody 1884 (IGHV2-26)
ARIQREVTIFGVVIFALDY

SEQ ID NO: 3769 - protein, 8 aa, Homo sapiens
  Light chain CDR3 for antibody 1885 (IGKV1-9)
QQLNSFPR

SEQ ID NO: 3770 - protein, 11 aa, Homo sapiens
  Heavy chain CDR3 for antibody 1885 (IGHV4-31)
ARGLSHYGMDV

SEQ ID NO: 3771 - protein, 9 aa, Homo sapiens
  Light chain CDR3 for antibody 1886 (IGKV1-39)
QQSDSTPRT

SEQ ID NO: 3772 - protein, 13 aa, Homo sapiens
  Heavy chain CDR3 for antibody 1886 (IGHV3-21)
ARGAGNFLYWFDP

SEQ ID NO: 3773 - protein, 9 aa, Homo sapiens
  Light chain CDR3 for antibody 1887 (IGKV1-39)
QQSDSTPRT

SEQ ID NO: 3774 - protein, 21 aa, Homo sapiens
  Heavy chain CDR3 for antibody 1887 (IGHV1-8)
ARGGWGSGGWYGKYFYYGMDV

SEQ ID NO: 3775 - protein, 10 aa, Homo sapiens
  Light chain CDR3 for antibody 1888 (IGKV3-11)
QQRSIWLGYT

SEQ ID NO: 3776 - protein, 20 aa, Homo sapiens
  Heavy chain CDR3 for antibody 1888 (IGHV3-33)
AKSGGTYCSGGNCYGYYFDY

SEQ ID NO: 3777 - protein, 9 aa, Homo sapiens
  Light chain CDR3 for antibody 1889 (IGKV1-16)
QQYHSYPFT

SEQ ID NO: 3778 - protein, 23 aa, Homo sapiens
  Heavy chain CDR3 for antibody 1889 (IGHV3-23)
ARTTYYDFWSGYWDPNYYYYMDV

SEQ ID NO: 3779 - protein, 9 aa, Homo sapiens
  Light chain CDR3 for antibody 1890 (IGKV1-5)
QQYNSYSWT

SEQ ID NO: 3780 - protein, 13 aa, Homo sapiens
  Heavy chain CDR3 for antibody 1890 (IGHV3-64)
ARDWGQVTTWFDP

SEQ ID NO: 3781 - protein, 9 aa, Homo sapiens
  Light chain CDR3 for antibody 1891 (IGKV1-27)
QRYNSAPLT

SEQ ID NO: 3782 - protein, 12 aa, Homo sapiens
  Heavy chain CDR3 for antibody 1891 (IGHV1-18)
ARDAGDQFLIRD

SEQ ID NO: 3783 - protein, 10 aa, Homo sapiens
  Light chain CDR3 for antibody 1892 (IGKV3-11)
QQRSIWLGYT

SEQ ID NO: 3784 - protein, 15 aa, Homo sapiens
  Heavy chain CDR3 for antibody 1892 (IGHV1-46)
ARDSEVVAAAGYFEH

SEQ ID NO: 3785 - protein, 9 aa, Homo sapiens
  Light chain CDR3 for antibody 1893 (IGKV4-1)
QQYYSSPLT

SEQ ID NO: 3786 - protein, 18 aa, Homo sapiens
  Heavy chain CDR3 for antibody 1893 (IGHV4-31)
ARGVASSSWLNHLYYMDV

SEQ ID NO: 3787 - protein, 9 aa, Homo sapiens
  Light chain CDR3 for antibody 1894 (IGKV1-13)
QHFNTYLLT

SEQ ID NO: 3788 - protein, 11 aa, Homo sapiens
  Heavy chain CDR3 for antibody 1894 (IGHV1-69)
ARENYGGAFDH

SEQ ID NO: 3789 - protein, 9 aa, Homo sapiens
  Light chain CDR3 for antibody 1895 (IGKV1-13)
QHFNTYFLT

SEQ ID NO: 3790 - protein, 18 aa, Homo sapiens
  Heavy chain CDR3 for antibody 1895 (IGHV1-18)
ARDSGYGGYDYWEPPLDY

SEQ ID NO: 3791 - protein, 10 aa, Homo sapiens
  Light chain CDR3 for antibody 1896 (IGKV1-39)
QQSYSTPPWT

SEQ ID NO: 3792 - protein, 10 aa, Homo sapiens
  Heavy chain CDR3 for antibody 1896 (IGHV3-21)
ARALSAAESY

SEQ ID NO: 3793 - protein, 8 aa, Homo sapiens
  Light chain CDR3 for antibody 1897 (IGKV1-5)
QQYNSYNT

SEQ ID NO: 3794 - protein, 13 aa, Homo sapiens
  Heavy chain CDR3 for antibody 1897 (IGHV4-39)
ARVPLTDFYYFDY

SEQ ID NO: 3795 - protein, 9 aa, Homo sapiens
  Light chain CDR3 for antibody 1898 (IGKV1-13)
QQFNSYPLT

SEQ ID NO: 3796 - protein, 14 aa, Homo sapiens
  Heavy chain CDR3 for antibody 1898 (IGHV4-59)
ARVWLVITTPDFDY

SEQ ID NO: 3797 - protein, 9 aa, Homo sapiens
  Light chain CDR3 for antibody 1899 (IGKV1-9)
QQLNSYPPL

SEQ ID NO: 3798 - protein, 16 aa, Homo sapiens
  Heavy chain CDR3 for antibody 1899 (IGHV3-53)
ARDDDCSSTSCSPFDY

SEQ ID NO: 3799 - protein, 10 aa, Homo sapiens
  Light chain CDR3 for antibody 1900 (IGKV1-5)
QQYKSNDPYT

SEQ ID NO: 3800 - protein, 14 aa, Homo sapiens
  Heavy chain CDR3 for antibody 1900 (IGHV4-39)
ARLTRGYSYGTIDY

SEQ ID NO: 3801 - protein, 6 aa, Homo sapiens
  Light chain CDR3 for antibody 1901 (IGKV5-2)
LQHDNL

SEQ ID NO: 3802 - protein, 20 aa, Homo sapiens
  Heavy chain CDR3 for antibody 1901 (IGHV3-48)
ARVKPARITIFGVVPPYMDV

SEQ ID NO: 3803 - protein, 10 aa, Homo sapiens
  Light chain CDR3 for antibody 1902 (IGKV1-39)
QQSYSTPPWT

SEQ ID NO: 3804 - protein, 20 aa, Homo sapiens
  Heavy chain CDR3 for antibody 1902 (IGHV3-33)
AKSGGTYCSGGNCYGYYFDY

SEQ ID NO: 3805 - protein, 9 aa, Homo sapiens
  Light chain CDR3 for antibody 1903 (IGKV3-11)
QQRSNWPIT

SEQ ID NO: 3806 - protein, 13 aa, Homo sapiens
  Heavy chain CDR3 for antibody 1903 (IGHV3-64)
ARDWGQVTTWFDP

SEQ ID NO: 3807 - protein, 9 aa, Homo sapiens
  Light chain CDR3 for antibody 1904 (IGKV1-9)
QQLNSYPHT

SEQ ID NO: 3808 - protein, 17 aa, Homo sapiens
  Heavy chain CDR3 for antibody 1904 (IGHV1-58)
AAGQSSGWDYYYYGMDV

SEQ ID NO: 3809 - protein, 9 aa, Homo sapiens
  Light chain CDR3 for antibody 1905 (IGKV1-39)
QQSYTSPPT

SEQ ID NO: 3810 - protein, 15 aa, Homo sapiens
  Heavy chain CDR3 for antibody 1905 (IGHV1-46)
ARDSEVVPAARYFQH

SEQ ID NO: 3811 - protein, 9 aa, Homo sapiens
  Light chain CDR3 for antibody 1906 (IGKV1-13)
QHFNTYFLT

SEQ ID NO: 3812 - protein, 15 aa, Homo sapiens
  Heavy chain CDR3 for antibody 1906 (IGHV1-46)
ARDSEVVPAARYFQH

SEQ ID NO: 3813 - protein, 9 aa, Homo sapiens
  Light chain CDR3 for antibody 1907 (IGKV1-12)
QQANSFPIT

SEQ ID NO: 3814 - protein, 11 aa, Homo sapiens
  Heavy chain CDR3 for antibody 1907 (IGHV3-53)
ARDLGPRGIDY

SEQ ID NO: 3815 - protein, 9 aa, Homo sapiens
  Light chain CDR3 for antibody 1908 (IGKV1-13)
QHFNTYLLT

SEQ ID NO: 3816 - protein, 19 aa, Homo sapiens
  Heavy chain CDR3 for antibody 1908 (IGHV5-51)
ARRMARGILEGRGRGAYDV

SEQ ID NO: 3817 - protein, 9 aa, Homo sapiens
  Light chain CDR3 for antibody 1909 (IGKV3-20)
QQYGSSPYT

SEQ ID NO: 3818 - protein, 11 aa, Homo sapiens
  Heavy chain CDR3 for antibody 1909 (IGHV3-53)
ARDLGPRGIDY

SEQ ID NO: 3819 - protein, 9 aa, Homo sapiens
  Light chain CDR3 for antibody 1910 (IGKV1-5)
QQYNSYSWT

SEQ ID NO: 3820 - protein, 14 aa, Homo sapiens
  Heavy chain CDR3 for antibody 1910 (IGHV1-69)
ARMYSGYYYYGMDV

SEQ ID NO: 3821 - protein, 9 aa, Homo sapiens
  Light chain CDR3 for antibody 1911 (IGKV1-33)
QQYDNLPLT

SEQ ID NO: 3822 - protein, 15 aa, Homo sapiens
  Heavy chain CDR3 for antibody 1911 (IGHV1-69)
ARSVLQLERRYAFDI

SEQ ID NO: 3823 - protein, 10 aa, Homo sapiens
  Light chain CDR3 for antibody 1912 (IGKV1-39)
QQSYSTLIFT

SEQ ID NO: 3824 - protein, 16 aa, Homo sapiens
  Heavy chain CDR3 for antibody 1912 (IGHV1-69)
ARVRSGSYGRLYYFDY

SEQ ID NO: 3825 - protein, 9 aa, Homo sapiens
  Light chain CDR3 for antibody 1913 (IGKV1-12)
QQANSFPYT

SEQ ID NO: 3826 - protein, 15 aa, Homo sapiens
  Heavy chain CDR3 for antibody 1913 (IGHV1-46)
ARAWDYGDYEGWFDP

SEQ ID NO: 3827 - protein, 10 aa, Homo sapiens
  Light chain CDR3 for antibody 1914 (IGKV1-33)
QQYDNLPSLT

SEQ ID NO: 3828 - protein, 15 aa, Homo sapiens
  Heavy chain CDR3 for antibody 1914 (IGHV3-48)
VRDHMSGQQLLRPDC

SEQ ID NO: 3829 - protein, 9 aa, Homo sapiens
  Light chain CDR3 for antibody 1915 (IGKV1-33)
QQSYSTPRT

SEQ ID NO: 3830 - protein, 20 aa, Homo sapiens
  Heavy chain CDR3 for antibody 1915 (IGHV4-30-2)
ARLPYYDFWSGYWTDSTGDY

SEQ ID NO: 3831 - protein, 9 aa, Homo sapiens
  Light chain CDR3 for antibody 1916 (IGKV1-39)
QQSYSTPQT

SEQ ID NO: 3832 - protein, 14 aa, Homo sapiens
  Heavy chain CDR3 for antibody 1916 (IGHV1-46)
ARVVAVAGYNWFDP

SEQ ID NO: 3833 - protein, 9 aa, Homo sapiens
  Light chain CDR3 for antibody 1917 (IGKV1-39)
QQSHSTPYT

SEQ ID NO: 3834 - protein, 10 aa, Homo sapiens
  Heavy chain CDR3 for antibody 1917 (IGHV4-28)
ATGDRVSVDY

SEQ ID NO: 3835 - protein, 8 aa, Homo sapiens
  Light chain CDR3 for antibody 1918 (IGKV2D-28)
MQALQTPL

SEQ ID NO: 3836 - protein, 23 aa, Homo sapiens
  Heavy chain CDR3 for antibody 1918 (IGHV3-11)
ARTTYYDFWSGYWDPNYYYYMDV

SEQ ID NO: 3837 - protein, 9 aa, Homo sapiens
  Light chain CDR3 for antibody 1919 (IGKV1-9)
QQLNSYPPL

SEQ ID NO: 3838 - protein, 20 aa, Homo sapiens
  Heavy chain CDR3 for antibody 1919 (IGHV2-26)
ARIGRERLIFGVVYYYYMDV

SEQ ID NO: 3839 - protein, 9 aa, Homo sapiens
  Light chain CDR3 for antibody 1920 (IGKV1-33)
QQYDNLPLT

SEQ ID NO: 3840 - protein, 15 aa, Homo sapiens
  Heavy chain CDR3 for antibody 1920 (IGHV1-46)
ARDSEVVPAARYFQH

SEQ ID NO: 3841 - protein, 9 aa, Homo sapiens
  Light chain CDR3 for antibody 1921 (IGKV1-5)
QQYNSYSWT

SEQ ID NO: 3842 - protein, 11 aa, Homo sapiens
  Heavy chain CDR3 for antibody 1921 (IGHV1-69)
ARENYGGACDY

SEQ ID NO: 3843 - protein, 9 aa, Homo sapiens
  Light chain CDR3 for antibody 1922 (IGKV1-39)
QQSYTTPRT

SEQ ID NO: 3844 - protein, 12 aa, Homo sapiens
  Heavy chain CDR3 for antibody 1922 (IGHV4-4)
AREEAMGRGLDV

SEQ ID NO: 3845 - protein, 8 aa, Homo sapiens
  Light chain CDR3 for antibody 1923 (IGKV1-5)
QQYNSYNT

SEQ ID NO: 3846 - protein, 13 aa, Homo sapiens
  Heavy chain CDR3 for antibody 1923 (IGHV3-64)
ARDWGQVTTWFDP

SEQ ID NO: 3847 - protein, 9 aa, Homo sapiens
  Light chain CDR3 for antibody 1924 (IGKV3-15)
QHYNDWQYS

SEQ ID NO: 3848 - protein, 11 aa, Homo sapiens
  Heavy chain CDR3 for antibody 1924 (IGHV4-59)
AAYDFWSSFDP

SEQ ID NO: 3849 - protein, 10 aa, Homo sapiens
  Light chain CDR3 for antibody 1925 (IGKV3-11)
QQRSIWPGYT

SEQ ID NO: 3850 - protein, 15 aa, Homo sapiens
  Heavy chain CDR3 for antibody 1925 (IGHV1-46)
ARDSEVVPAARYFHH

SEQ ID NO: 3851 - protein, 6 aa, Homo sapiens
  Light chain CDR3 for antibody 1926 (IGKV1-33)
QQNEGA

SEQ ID NO: 3852 - protein, 15 aa, Homo sapiens
  Heavy chain CDR3 for antibody 1926 (IGHV1-46)
ARDSEVVPAARYFQH

SEQ ID NO: 3853 - protein, 10 aa, Homo sapiens [sequence omitted]

SEQ ID NO: 3854 - protein, 21 aa, Homo sapiens
  Heavy chain CDR3 for antibody 1927 (IGHV3-33)
AKAGGGSYCGGGSCYSGYFDY

SEQ ID NO: 3855 - protein, 8 aa, Homo sapiens
  Light chain CDR3 for antibody 1928 (IGKV3-11)
QQRSNWLT

SEQ ID NO: 3856 - protein, 17 aa, Homo sapiens
  Heavy chain CDR3 for antibody 1928 (IGHV4-39)
ARPSSPTPTTVYWYFDL

SEQ ID NO: 3857 - protein, 9 aa, Homo sapiens
  Light chain CDR3 for antibody 1929 (IGKV1-12)
QQANSFPIT

SEQ ID NO: 3858 - protein, 13 aa, Homo sapiens
  Heavy chain CDR3 for antibody 1929 (IGHV3-64)
ARDWGQVTTWFDP

SEQ ID NO: 3859 - protein, 10 aa, Homo sapiens
  Light chain CDR3 for antibody 1930 (IGKV1-5)
QQYKSNDPYT

SEQ ID NO: 3860 - protein, 13 aa, Homo sapiens
  Heavy chain CDR3 for antibody 1930 (IGHV4-39)
ARVPLTDFYYFDY

SEQ ID NO: 3861 - protein, 9 aa, Homo sapiens
  Light chain CDR3 for antibody 1931 (IGKV1-27)
QNYYSAPET

SEQ ID NO: 3862 - protein, 8 aa, Homo sapiens
  Heavy chain CDR3 for antibody 1931 (IGHV3-53)
ATHPDHAY

SEQ ID NO: 3863 - protein, 9 aa, Homo sapiens
  Light chain CDR3 for antibody 1932 (IGKV1-9)
QQLNSYPPL

SEQ ID NO: 3864 - protein, 26 aa, Homo sapiens
  Heavy chain CDR3 for antibody 1932 (IGHV1-46)
AREGNVDYDFWSGYSRPRYYYYYMDV

SEQ ID NO: 3865 - protein, 9 aa, Homo sapiens
  Light chain CDR3 for antibody 1933 (IGKV3-20)
QQYGSSRGT

SEQ ID NO: 3866 - protein, 13 aa, Homo sapiens
  Heavy chain CDR3 for antibody 1933 (IGHV5-51)
ARPTYGAKWGLDY

SEQ ID NO: 3867 - protein, 10 aa, Homo sapiens
  Light chain CDR3 for antibody 1934 (IGKV1-5)
QQYKSNDPYT

SEQ ID NO: 3868 - protein, 15 aa, Homo sapiens
  Heavy chain CDR3 for antibody 1934 (IGHV1-69)
ARSVLQLERRYAFDI

SEQ ID NO: 3869 - protein, 9 aa, Homo sapiens
  Light chain CDR3 for antibody 1935 (IGKV1-9)
QQLNSYPPL

SEQ ID NO: 3870 - protein, 10 aa, Homo sapiens
  Heavy chain CDR3 for antibody 1935 (IGHV4-28)
ATGDRVSVDY

SEQ ID NO: 3871 - protein, 10 aa, Homo sapiens
  Light chain CDR3 for antibody 1936 (IGKV2-30)
MQGTHWPPWT

SEQ ID NO: 3872 - protein, 22 aa, Homo sapiens
  Heavy chain CDR3 for antibody 1936 (IGHV3-11)
ARGETSSTSSARARYYYYYMDV

SEQ ID NO: 3873 - protein, 9 aa, Homo sapiens
  Light chain CDR3 for antibody 1937 (IGKV1-12)
QQANSFPIT

SEQ ID NO: 3874 - protein, 16 aa, Homo sapiens
  Heavy chain CDR3 for antibody 1937 (IGHV3-13)
ARGITTAAGLKYYFDY

SEQ ID NO: 3875 - protein, 10 aa, Homo sapiens
  Light chain CDR3 for antibody 1938 (IGKV3-20)
QQYGSSPLFT

SEQ ID NO: 3876 - protein, 16 aa, Homo sapiens
  Heavy chain CDR3 for antibody 1938 (IGHV1-69)
ARSDSADWELPGAFDI

SEQ ID NO: 3877 - protein, 8 aa, Homo sapiens
  Light chain CDR3 for antibody 1939 (IGKV6-21)
HQTSSVYT

SEQ ID NO: 3878 - protein, 11 aa, Homo sapiens
  Heavy chain CDR3 for antibody 1939 (IGHV3-53)
ARDLGPREIDY

SEQ ID NO: 3879 - protein, 9 aa, Homo sapiens
  Light chain CDR3 for antibody 1940 (IGKV1-17)
LQHKSYPLT

SEQ ID NO: 3880 - protein, 18 aa, Homo sapiens
  Heavy chain CDR3 for antibody 1940 (IGHV1-18)
ARDSGYGGYDYWEPPLDY

SEQ ID NO: 3881 - protein, 10 aa, Homo sapiens
  Light chain CDR3 for antibody 1941 (IGKV3-20)
QQHGSSLTWT

SEQ ID NO: 3882 - protein, 15 aa, Homo sapiens
  Heavy chain CDR3 for antibody 1941 (IGHV3-30)
AREGPWWEIRAASDS

SEQ ID NO: 3883 - protein, 8 aa, Homo sapiens
  Light chain CDR3 for antibody 1942 (IGKV1-5)
QQYKSYWT

SEQ ID NO: 3884 - protein, 15 aa, Homo sapiens
  Heavy chain CDR3 for antibody 1942 (IGHV1-46)
ARDSEVVPAARYFQH

SEQ ID NO: 3885 - protein, 9 aa, Homo sapiens
  Light chain CDR3 for antibody 1943 (IGKV1-39)
QQSDSTPRT

SEQ ID NO: 3886 - protein, 18 aa, Homo sapiens
  Heavy chain CDR3 for antibody 1943 (IGHV1-18)
ARDSGYGGCDYWEAALDY

SEQ ID NO: 3887 - protein, 9 aa, Homo sapiens
  Light chain CDR3 for antibody 1944 (IGKV1-5)
QQYNSYPLT

SEQ ID NO: 3888 - protein, 22 aa, Homo sapiens
  Heavy chain CDR3 for antibody 1944 (IGHV3-13)
ARGETSSTSSARARYYYYYMDV

SEQ ID NO: 3889 - protein, 8 aa, Homo sapiens
  Light chain CDR3 for antibody 1945 (IGKV6-21)
HQTSSVYT

SEQ ID NO: 3890 - protein, 13 aa, Homo sapiens
  Heavy chain CDR3 for antibody 1945 (IGHV4-30-2)
ASSVDTAMGDFYY

SEQ ID NO: 3891 - protein, 9 aa, Homo sapiens
  Light chain CDR3 for antibody 1946 (IGKV1-39)
QQSDSTPRT

SEQ ID NO: 3892 - protein, 18 aa, Homo sapiens
  Heavy chain CDR3 for antibody 1946 (IGHV1-18)
ARDSGYGGCEYGEPPLDY

SEQ ID NO: 3893 - protein, 9 aa, Homo sapiens
  Light chain CDR3 for antibody 1947 (IGKV1-39)
QQSHSTPYT

SEQ ID NO: 3894 - protein, 18 aa, Homo sapiens
  Heavy chain CDR3 for antibody 1947 (IGHV1-18)
ARDSGYGRYDYWEPPLDY

SEQ ID NO: 3895 - protein, 9 aa, Homo sapiens
  Light chain CDR3 for antibody 1948 (IGKV1-39)
QQSDSTPYT

SEQ ID NO: 3896 - protein, 13 aa, Homo sapiens
  Heavy chain CDR3 for antibody 1948 (IGHV4-31)
ATPGESDSDAFDI

SEQ ID NO: 3897 - protein, 9 aa, Homo sapiens
  Light chain CDR3 for antibody 1949 (IGKV1-39)
QQSYSIPFT

SEQ ID NO: 3898 - protein, 16 aa, Homo sapiens
  Heavy chain CDR3 for antibody 1949 (IGHV3-23)
AKDVPDTAMLSGWFDP

SEQ ID NO: 3899 - protein, 10 aa, Homo sapiens
  Light chain CDR3 for antibody 1950 (IGKV3-20)
QQYGSSPPIT

SEQ ID NO: 3900 - protein, 15 aa, Homo sapiens
  Heavy chain CDR3 for antibody 1950 (IGHV1-46)
ARDSEVVPAARYFQH

SEQ ID NO: 3901 - protein, 9 aa, Homo sapiens
  Light chain CDR3 for antibody 1951 (IGKV1-39)
QQSDSTPRT

SEQ ID NO: 3902 - protein, 15 aa, Homo sapiens
  Heavy chain CDR3 for antibody 1951 (IGHV1-18)
ARAWDYGDYEGWFDP

SEQ ID NO: 3903 - protein, 9 aa, Homo sapiens
  Light chain CDR3 for antibody 1952 (IGKV3-11)
QQRSNWPIT

SEQ ID NO: 3904 - protein, 14 aa, Homo sapiens
  Heavy chain CDR3 for antibody 1952 (IGHV2-70)
ARTPIAAAGSPFDP

SEQ ID NO: 3905 - protein, 9 aa, Homo sapiens
  Light chain CDR3 for antibody 1953 (IGKV1-16)
QQYHSYPFT

SEQ ID NO: 3906 - protein, 17 aa, Homo sapiens
  Heavy chain CDR3 for antibody 1953 (IGHV5-51)
ARPRPEDYYASHWYFDL

SEQ ID NO: 3907 - protein, 8 aa, Homo sapiens
  Light chain CDR3 for antibody 1954 (IGKV1-5)
QQYKSYWT

SEQ ID NO: 3908 - protein, 15 aa, Homo sapiens
  Heavy chain CDR3 for antibody 1954 (IGHV3-48)
ARVSPGIVGALHTDY

SEQ ID NO: 3909 - protein, 9 aa, Homo sapiens
  Light chain CDR3 for antibody 1955 (IGKV1-33)
QQYDNLPLT

SEQ ID NO: 3910 - protein, 13 aa, Homo sapiens
  Heavy chain CDR3 for antibody 1955 (IGHV3-64)
ARDWGQVTTWFDP

SEQ ID NO: 3911 - protein, 8 aa, Homo sapiens
  Light chain CDR3 for antibody 1956 (IGKV1-5)
QQYNSYNT

SEQ ID NO: 3912 - protein, 21 aa, Homo sapiens
  Heavy chain CDR3 for antibody 1956 (IGHV3-33)
AKAGGGSYCGGGSCYSGYFDY

SEQ ID NO: 3913 - protein, 10 aa, Homo sapiens
  Light chain CDR3 for antibody 1957 (IGKV3-15)
HQYNKWPPFT

SEQ ID NO: 3914 - protein, 14 aa, Homo sapiens
  Heavy chain CDR3 for antibody 1957 (IGHV2-70)
ARTPIAAAGSPFDP

SEQ ID NO: 3915 - protein, 9 aa, Homo sapiens
  Light chain CDR3 for antibody 1958 (IGKV1-39)
QQSYSTPYT

SEQ ID NO: 3916 - protein, 19 aa, Homo sapiens
  Heavy chain CDR3 for antibody 1958 (IGHV4-61)
ASHTKRITIFGVVTDYFDY

SEQ ID NO: 3917 - protein, 6 aa, Homo sapiens
  Light chain CDR3 for antibody 1959 (IGKV1-33)
QQNEGA

SEQ ID NO: 3918 - protein, 14 aa, Homo sapiens
  Heavy chain CDR3 for antibody 1959 (IGHV2-70)
ARTPIAAAGSPFDP

SEQ ID NO: 3919 - protein, 9 aa, Homo sapiens
  Light chain CDR3 for antibody 1960 (IGKV1-13)
QHFNTYFLT

SEQ ID NO: 3920 - protein, 11 aa, Homo sapiens
  Heavy chain CDR3 for antibody 1960 (IGHV3-53)
ARDLGPRGIDY

SEQ ID NO: 3921 - protein, 9 aa, Homo sapiens
  Light chain CDR3 for antibody 1961 (IGKV1-13)
QQYSTYPLT

SEQ ID NO: 3922 - protein, 14 aa, Homo sapiens
  Heavy chain CDR3 for antibody 1961 (IGHV2-70)
ARTPIAAAGSPFDP

SEQ ID NO: 3923 - protein, 10 aa, Homo sapiens
  Light chain CDR3 for antibody 1962 (IGKV3-11)
QQRSIWLGYT

SEQ ID NO: 3924 - protein, 15 aa, Homo sapiens
  Heavy chain CDR3 for antibody 1962 (IGHV1-46)
ASDSEGVPAARYFEH

SEQ ID NO: 3925 - protein, 9 aa, Homo sapiens
  Light chain CDR3 for antibody 1963 (IGKV1-39)
QQSYSTPYT

SEQ ID NO: 3926 - protein, 17 aa, Homo sapiens
  Heavy chain CDR3 for antibody 1963 (IGHV1-24)
AAEGIVGATVSYYGMDV

SEQ ID NO: 3927 - protein, 9 aa, Homo sapiens
  Light chain CDR3 for antibody 1964 (IGKV1-39)
QQSDSTPRT

SEQ ID NO: 3928 - protein, 18 aa, Homo sapiens
  Heavy chain CDR3 for antibody 1964 (IGHV1-18)
ARYSGYGGDEYWDPPLDY

SEQ ID NO: 3929 - protein, 10 aa, Homo sapiens
  Light chain CDR3 for antibody 1965 (IGKV3-20)
QQYGSSPPIT

SEQ ID NO: 3930 - protein, 14 aa, Homo sapiens
  Heavy chain CDR3 for antibody 1965 (IGHV2-70)
ARTPIAAAGSPFDP

SEQ ID NO: 3931 - protein, 10 aa, Homo sapiens
  Light chain CDR3 for antibody 1966 (IGKV3-11)
QQRSIWLGYT

SEQ ID NO: 3932 - protein, 21 aa, Homo sapiens
  Heavy chain CDR3 for antibody 1966 (IGHV1-8)
ARGGWGSGGWYGKYFYYGMDV

SEQ ID NO: 3933 - protein, 9 aa, Homo sapiens
  Light chain CDR3 for antibody 1967 (IGKV1-33)
QQYSNLPRT

SEQ ID NO: 3934 - protein, 9 aa, Homo sapiens
  Heavy chain CDR3 for antibody 1967 (IGHV4-59)
VRGRNNFRY

SEQ ID NO: 3935 - protein, 8 aa, Homo sapiens
  Light chain CDR3 for antibody 1968 (IGKV1-9)
QQSYSTLT

SEQ ID NO: 3936 - protein, 15 aa, Homo sapiens
  Heavy chain CDR3 for antibody 1968 (IGHV1-69)
ARAVLQLERRYAFDI

SEQ ID NO: 3937 - protein, 9 aa, Homo sapiens
  Light chain CDR3 for antibody 1969 (IGKV1-5)
QQYNSYSWT

SEQ ID NO: 3938 - protein, 20 aa, Homo sapiens
  Heavy chain CDR3 for antibody 1969 (IGHV3-33)
AKSGGTYCSGGNCYGYYFDY

SEQ ID NO: 3939 - protein, 9 aa, Homo sapiens
  Light chain CDR3 for antibody 1970 (IGKV1-33)
QQSYSTPRT

SEQ ID NO: 3940 - protein, 18 aa, Homo sapiens
  Heavy chain CDR3 for antibody 1970 (IGHV1-18)
ATDSGYGGYDYWEPPIDY

SEQ ID NO: 3941 - protein, 9 aa, Homo sapiens
  Light chain CDR3 for antibody 1971 (IGKV1-13)
QHFNTYFLT

SEQ ID NO: 3942 - protein, 15 aa, Homo sapiens
  Heavy chain CDR3 for antibody 1971 (IGHV1-69)
ARSVLQLERRYAFDI

SEQ ID NO: 3943 - protein, 9 aa, Homo sapiens
  Light chain CDR3 for antibody 1972 (IGKV1-33)
QQYDNLPLT

SEQ ID NO: 3944 - protein, 20 aa, Homo sapiens
  Heavy chain CDR3 for antibody 1972 (IGHV3-33)
AKSGGTYCSGGNCYGYYFDY

SEQ ID NO: 3945 - protein, 9 aa, Homo sapiens
  Light chain CDR3 for antibody 1973 (IGKV1-5)
QQYNSYSWT

SEQ ID NO: 3946 - protein, 21 aa, Homo sapiens
  Heavy chain CDR3 for antibody 1973 (IGHV1-8)
ARGGWGSGGWYGKYFYYGMDV

SEQ ID NO: 3947 - protein, 10 aa, Homo sapiens
  Light chain CDR3 for antibody 1974 (IGKV1-39)
QQSYSTPPWT

SEQ ID NO: 3948 - protein, 21 aa, Homo sapiens
  Heavy chain CDR3 for antibody 1974 (IGHV1-8)
ARGGWGSGGWYGKYFYYGMDV

SEQ ID NO: 3949 - protein, 9 aa, Homo sapiens
  Light chain CDR3 for antibody 1975 (IGKV1-9)
QQLNSYPPL

SEQ ID NO: 3950 - protein, 11 aa, Homo sapiens
  Heavy chain CDR3 for antibody 1975 (IGHV3-53)
ARENYGGACDY

SEQ ID NO: 3951 - protein, 8 aa, Homo sapiens
  Light chain CDR3 for antibody 1976 (IGKV1-5)
QQYNSYNT

SEQ ID NO: 3952 - protein, 18 aa, Homo sapiens
  Heavy chain CDR3 for antibody 1976 (IGHV1-18)
ARDSGYGGYDYWEPPLDY

SEQ ID NO: 3953 - protein, 9 aa, Homo sapiens
  Light chain CDR3 for antibody 1977 (IGKV3-11)
QQRSNWPLS

SEQ ID NO: 3954 - protein, 18 aa, Homo sapiens
  Heavy chain CDR3 for antibody 1977 (IGHV1-18)
ARDSGYGGYDYWEPPLDY

SEQ ID NO: 3955 - protein, 10 aa, Homo sapiens
  Light chain CDR3 for antibody 1978 (IGKV3-11)
QQRSIWLGYT

SEQ ID NO: 3956 - protein, 16 aa, Homo sapiens
  Heavy chain CDR3 for antibody 1978 (IGHV3-13)
ARGITTAAGLKYYFDY

SEQ ID NO: 3957 - protein, 9 aa, Homo sapiens
  Light chain CDR3 for antibody 1979 (IGKV1-39)
QQSYSSHWT

SEQ ID NO: 3958 - protein, 21 aa, Homo sapiens
  Heavy chain CDR3 for antibody 1979 (IGHV3-13)
AKAGGGSYCGGGSCYSGYFDY

SEQ ID NO: 3959 - protein, 8 aa, Homo sapiens
  Light chain CDR3 for antibody 1980 (IGKV1-5)
QQYNSYNT

SEQ ID NO: 3960 - protein, 15 aa, Homo sapiens
  Heavy chain CDR3 for antibody 1980 (IGHV1-69)
ARSVLQLERRYAFDI

SEQ ID NO: 3961 - protein, 9 aa, Homo sapiens
  Light chain CDR3 for antibody 1981 (IGKV1-17)
LQHNSYPLT

SEQ ID NO: 3962 - protein, 13 aa, Homo sapiens
  Heavy chain CDR3 for antibody 1981 (IGHV3-21)
TRSYWTGYNWFDP

SEQ ID NO: 3963 - protein, 9 aa, Homo sapiens
  Light chain CDR3 for antibody 1982 (IGKV3-11)
QQRSNWPIT

SEQ ID NO: 3964 - protein, 11 aa, Homo sapiens
  Heavy chain CDR3 for antibody 1982 (IGHV3-53)
ARDLGPRGIDY

SEQ ID NO: 3965 - protein, 10 aa, Homo sapiens
  Light chain CDR3 for antibody 1983 (IGKV1-33)
QQYDNLPPYT

SEQ ID NO: 3966 - protein, 16 aa, Homo sapiens
  Heavy chain CDR3 for antibody 1983 (IGHV3-30)
AKHGYSYGYWLGYFDY

SEQ ID NO: 3967 - protein, 9 aa, Homo sapiens
  Light chain CDR3 for antibody 1984 (IGKV1-33)
QQYDNLPRT

SEQ ID NO: 3968 - protein, 12 aa, Homo sapiens
  Heavy chain CDR3 for antibody 1984 (IGHV3-66)
ARDCLGIPSMDV

SEQ ID NO: 3969 - protein, 9 aa, Homo sapiens
  Light chain CDR3 for antibody 1985 (IGKV1-6)
LQDYNYPRT

SEQ ID NO: 3970 - protein, 10 aa, Homo sapiens
  Heavy chain CDR3 for antibody 1985 (IGHV3-53)
ARDLASGEGP

SEQ ID NO: 3971 - protein, 11 aa, Homo sapiens
  Light chain CDR3 for antibody 1986 (IGKV1-9)
QQLNSYPPGDT

SEQ ID NO: 3972 - protein, 12 aa, Homo sapiens
  Heavy chain CDR3 for antibody 1986 (IGHV3-53)
ARDLGYAGGLDY

SEQ ID NO: 3973 - protein, 6 aa, Homo sapiens
  Light chain CDR3 for antibody 1987 (IGKV3-20)
QQSTYT

SEQ ID NO: 3974 - protein, 11 aa, Homo sapiens
  Heavy chain CDR3 for antibody 1987 (IGHV3-53)
ARAYGDYYFDY

SEQ ID NO: 3975 - protein, 9 aa, Homo sapiens
  Light chain CDR3 for antibody 1988 (IGKV1-13)
QQFNSYPRT

SEQ ID NO: 3976 - protein, 11 aa, Homo sapiens
  Heavy chain CDR3 for antibody 1988 (IGHV3-66)
ARDWGDYYFDY

SEQ ID NO: 3977 - protein, 9 aa, Homo sapiens
  Light chain CDR3 for antibody 1989 (IGKV1-6)
LQNKDAAWT

SEQ ID NO: 3978 - protein, 16 aa, Homo sapiens
  Heavy chain CDR3 for antibody 1989 (IGHV1-2)
ARGDVVDPGVALVLDV

SEQ ID NO: 3979 - protein, 10 aa, Homo sapiens
  Light chain CDR3 for antibody 1990 (IGKV1-39)
QQSYSTPPFT

SEQ ID NO: 3980 - protein, 14 aa, Homo sapiens
  Heavy chain CDR3 for antibody 1990 (IGHV3-66)
ARVEFYGGKGAFDI

SEQ ID NO: 3981 - protein, 9 aa, Homo sapiens
  Light chain CDR3 for antibody 1991 (IGKV1-33)
QQYDNLPRT

SEQ ID NO: 3982 - protein, 16 aa, Homo sapiens
  Heavy chain CDR3 for antibody 1991 (IGHV3-30)
AKHGYSYGYWLGYFDY

SEQ ID NO: 3983 - protein, 9 aa, Homo sapiens
  Light chain CDR3 for antibody 1992 (IGKV1-33)
QQYDNLPFT

SEQ ID NO: 3984 - protein, 19 aa, Homo sapiens
  Heavy chain CDR3 for antibody 1992 (IGHV3-33)
ARDGQGIAAAGTISSAFDI

SEQ ID NO: 3985 - protein, 10 aa, Homo sapiens
  Light chain CDR3 for antibody 1993 (IGKV1-33)
QQYDNLPPYT

SEQ ID NO: 3986 - protein, 12 aa, Homo sapiens
  Heavy chain CDR3 for antibody 1993 (IGHV3-66)
ARDCLGIPSMDV

SEQ ID NO: 3987 - protein, 8 aa, Homo sapiens
  Light chain CDR3 for antibody 1994 (IGKV3-20)
QQYGSSPP

SEQ ID NO: 3988 - protein, 22 aa, Homo sapiens
  Heavy chain CDR3 for antibody 1994 (IGHV1-69)
ARGGWGTSSSWGPSYYYYYMDV

SEQ ID NO: 3989 - protein, 11 aa, Homo sapiens
  Light chain CDR3 for antibody 1995 (IGKV1-9)
QQLNSYPPGDT

SEQ ID NO: 3990 - protein, 16 aa, Homo sapiens
  Heavy chain CDR3 for antibody 1995 (IGHV3-30)
AKHGYSYGYWLGYFDY

SEQ ID NO: 3991 - protein, 9 aa, Homo sapiens
  Light chain CDR3 for antibody 1996 (IGKV3-20)
QQYGSSPRT

SEQ ID NO: 3992 - protein, 15 aa, Homo sapiens
  Heavy chain CDR3 for antibody 1996 (IGHV4-61)
ASSWGYGSGSYYSDY

SEQ ID NO: 3993 - protein, 9 aa, Homo sapiens
  Light chain CDR3 for antibody 1997 (IGKV1-6)
LQDYNYPRT

SEQ ID NO: 3994 - protein, 16 aa, Homo sapiens
  Heavy chain CDR3 for antibody 1997 (IGHV3-30)
AKHGYSYGYWLGYFDY

SEQ ID NO: 3995 - protein, 10 aa, Homo sapiens
  Light chain CDR3 for antibody 1998 (IGKV1-33)
QQYDNLPPYT

SEQ ID NO: 3996 - protein, 12 aa, Homo sapiens
  Heavy chain CDR3 for antibody 1998 (IGHV3-53)
ARDLGYAGGLDY

SEQ ID NO: 3997 - protein, 9 aa, Homo sapiens
  Light chain CDR3 for antibody 1999 (IGKV1-33)
QQYDNLPRT

SEQ ID NO: 3998 - protein, 10 aa, Homo sapiens
  Heavy chain CDR3 for antibody 1999 (IGHV3-53)
ARDLASGEGP

SEQ ID NO: 3999 - protein, 6 aa, Homo sapiens
  Light chain CDR3 for antibody 2000 (IGKV3-20)
QQSTYT

SEQ ID NO: 4000 - protein, 16 aa, Homo sapiens
  Heavy chain CDR3 for antibody 2000 (IGHV3-30)
AKHGYSYGYWLGYFDY

SEQ ID NO: 4001 - protein, 10 aa, Homo sapiens
  Light chain CDR3 for antibody 2001 (IGKV1-33)
QQYDNLPPYT

SEQ ID NO: 4002 - protein, 10 aa, Homo sapiens
  Heavy chain CDR3 for antibody 2001 (IGHV3-53)
ARDLASGEGP

SEQ ID NO: 4003 - protein, 10 aa, Homo sapiens
  Light chain CDR3 for antibody 2002 (IGKV1-33)
QQYDNLPPYT

SEQ ID NO: 4004 - protein, 11 aa, Homo sapiens
  Heavy chain CDR3 for antibody 2002 (IGHV3-53)
ARAYGDYYFDY

SEQ ID NO: 4005 - protein, 9 aa, Homo sapiens
  Light chain CDR3 for antibody 2003 (IGKV1-33)
QQYDNLPRT

SEQ ID NO: 4006 - protein, 12 aa, Homo sapiens
  Heavy chain CDR3 for antibody 2003 (IGHV3-53)
ARDLGYAGGLDY

SEQ ID NO: 4007 - protein, 10 aa, Homo sapiens
  Light chain CDR3 for antibody 2004 (IGKV1-9)
QQLNSYPPYT

SEQ ID NO: 4008 - protein, 12 aa, Homo sapiens
  Heavy chain CDR3 for antibody 2004 (IGHV3-53)
ARDLGYAGGLDY

SEQ ID NO: 4009 - protein, 10 aa, Homo sapiens
  Light chain CDR3 for antibody 2005 (IGKV1-33)
QQYDNLLLLT

SEQ ID NO: 4010 - protein, 18 aa, Homo sapiens
  Heavy chain CDR3 for antibody 2005 (IGHV3-11)
ATPRGYGSGWYVLWAFDI

SEQ ID NO: 4011 - protein, 9 aa, Homo sapiens
  Light chain CDR3 for antibody 2006 (IGKV1-33)
QQYDNLPRT

SEQ ID NO: 4012 - protein, 11 aa, Homo sapiens
  Heavy chain CDR3 for antibody 2006 (IGHV3-53)
ARAYGDYYFDY

SEQ ID NO: 4013 - protein, 9 aa, Homo sapiens
  Light chain CDR3 for antibody 2007 (IGKV1-6)
LQDYNYPRT

SEQ ID NO: 4014 - protein, 12 aa, Homo sapiens
  Heavy chain CDR3 for antibody 2007 (IGHV3-66)
ARDCLGIPSMDV

SEQ ID NO: 4015 - protein, 11 aa, Homo sapiens
  Light chain CDR3 for antibody 2008 (IGKV1-9)
QQLNSYPPGDT

SEQ ID NO: 4016 - protein, 12 aa, Homo sapiens
  Heavy chain CDR3 for antibody 2008 (IGHV3-66)
ARDCLGIPSMDV

SEQ ID NO: 4017 - protein, 8 aa, Homo sapiens
  Light chain CDR3 for antibody 2009 (IGKV4-1)
QQYYSTRT

SEQ ID NO: 4018 - protein, 17 aa, Homo sapiens
  Heavy chain CDR3 for antibody 2009 (IGHV4-31)
ASSRGGDYGDYSGPFDY

SEQ ID NO: 4019 - protein, 9 aa, Homo sapiens
  Light chain CDR3 for antibody 2010 (IGKV1-6)
LQDYNYPRT

SEQ ID NO: 4020 - protein, 12 aa, Homo sapiens
  Heavy chain CDR3 for antibody 2010 (IGHV3-53)
ARDLGYAGGLDY

SEQ ID NO: 4021 - protein, 11 aa, Homo sapiens
  Light chain CDR3 for antibody 2011 (IGKV1-9)
QQLNSYPPGDT

SEQ ID NO: 4022 - protein, 10 aa, Homo sapiens
  Heavy chain CDR3 for antibody 2011 (IGHV3-53)
ARDLASGEGP

SEQ ID NO: 4023 - protein, 6 aa, Homo sapiens
  Light chain CDR3 for antibody 2012 (IGKV3-20)
QQSTYT

SEQ ID NO: 4024 - protein, 12 aa, Homo sapiens
  Heavy chain CDR3 for antibody 2012 (IGHV3-66)
ARDCLGIPSMDV

SEQ ID NO: 4025 - protein, 9 aa, Homo sapiens
  Light chain CDR3 for antibody 2013 (IGKV1-6)
LQDYNYPRT

SEQ ID NO: 4026 - protein, 11 aa, Homo sapiens
  Heavy chain CDR3 for antibody 2013 (IGHV3-53)
ARAYGDYYFDY

SEQ ID NO: 4027 - protein, 8 aa, Homo sapiens
  Light chain CDR3 for antibody 2014 (IGKV3-20)
QQYGSSPP

SEQ ID NO: 4028 - protein, 12 aa, Homo sapiens
  Heavy chain CDR3 for antibody 2014 (IGHV1-69)
ARREIVVGAFDI

SEQ ID NO: 4029 - protein, 9 aa, Homo sapiens
  Light chain CDR3 for antibody 2015 (IGKV3-20)
QQYGSSPLT

SEQ ID NO: 4030 - protein, 12 aa, Homo sapiens
  Heavy chain CDR3 for antibody 2015 (IGHV2-5)
AHRRNFLGHFDY

SEQ ID NO: 4031 - protein, 6 aa, Homo sapiens
  Light chain CDR3 for antibody 2016 (IGKV3-20)
QQSTYT

SEQ ID NO: 4032 - protein, 12 aa, Homo sapiens
  Heavy chain CDR3 for antibody 2016 (IGHV3-53)
ARDLGYAGGLDY

SEQ ID NO: 4033 - protein, 8 aa, Homo sapiens
  Light chain CDR3 for antibody 2017 (IGKV2D-28)
MQALQTLT

SEQ ID NO: 4034 - protein, 18 aa, Homo sapiens
  Heavy chain CDR3 for antibody 2017 (IGHV5-51)
ARSMLPGYQLLYREGMDV

SEQ ID NO: 4035 - protein, 9 aa, Homo sapiens
  Light chain CDR3 for antibody 2018 (IGKV1-8)
QQYYSYPLT

SEQ ID NO: 4036 - protein, 20 aa, Homo sapiens
  Heavy chain CDR3 for antibody 2018 (IGHV5-a)
ARRGKQWLAGYYYYYYYMDV

SEQ ID NO: 4037 - protein, 9 aa, Homo sapiens
  Light chain CDR3 for antibody 2019 (IGKV3-20)
QQYGSSPWT

SEQ ID NO: 4038 - protein, 13 aa, Homo sapiens
  Heavy chain CDR3 for antibody 2019 (IGHV4-59)
ARVPGHSSGWHDY

SEQ ID NO: 4039 - protein, 11 aa, Homo sapiens
  Light chain CDR3 for antibody 2020 (IGKV1-9)
QQLNSYPPGDT

SEQ ID NO: 4040 - protein, 11 aa, Homo sapiens
  Heavy chain CDR3 for antibody 2020 (IGHV3-53)
ARAYGDYYFDY

SEQ ID NO: 4041 - protein, 6 aa, Homo sapiens
  Light chain CDR3 for antibody 2021 (IGKV3-20)
QQSTYT

SEQ ID NO: 4042 - protein, 10 aa, Homo sapiens
  Heavy chain CDR3 for antibody 2021 (IGHV3-53)
ARDLASGEGP

SEQ ID NO: 4043 - protein, 9 aa, Homo sapiens
  Light chain CDR3 for antibody 2022 (IGKV3-20)
QQYGSSPLT

SEQ ID NO: 4044 - protein, 22 aa, Homo sapiens
  Heavy chain CDR3 for antibody 2022 (IGHV1-69)
ARGGWGTSSSWGPSYYYYYMDV

SEQ ID NO: 4045 - protein, 9 aa, Homo sapiens
  Light chain CDR3 for antibody 2023 (IGKV3-11)
QQRSNWPKT

SEQ ID NO: 4046 - protein, 11 aa, Homo sapiens
  Heavy chain CDR3 for antibody 2023 (IGHV1-69)
ASRDTYNWFDP

SEQ ID NO: 4047 - protein, 8 aa, Homo sapiens
  Light chain CDR3 for antibody 2024 (IGKV1-33)
QQYHSLLT

SEQ ID NO: 4048 - protein, 11 aa, Homo sapiens
  Heavy chain CDR3 for antibody 2024 (IGHV4-61)
ALSYGSSIFDY

SEQ ID NO: 4049 - protein, 9 aa, Homo sapiens
  Light chain CDR3 for antibody 2025 (IGKV1-39)
QQSYSTPLT

SEQ ID NO: 4050 - protein, 22 aa, Homo sapiens
  Heavy chain CDR3 for antibody 2025 (IGHV3-74)
ARVVDTAMVDGINYYYYYGMDV

SEQ ID NO: 4051 - protein, 10 aa, Homo sapiens
  Light chain CDR3 for antibody 2026 (IGKV3-20)
QQYNNWLLYT

SEQ ID NO: 4052 - protein, 13 aa, Homo sapiens
  Heavy chain CDR3 for antibody 2026 (IGHV4-61)
ARDGPGEYYYFDY

SEQ ID NO: 4053 - protein, 9 aa, Homo sapiens
  Light chain CDR3 for antibody 2027 (IGKV3-20)
QQYGSSPWT

SEQ ID NO: 4054 - protein, 19 aa, Homo sapiens
  Heavy chain CDR3 for antibody 2027 (IGHV4-61)
ARERVGVQWPVYYYYGMDV

SEQ ID NO: 4055 - protein, 9 aa, Homo sapiens
  Light chain CDR3 for antibody 2028 (IGKV1-13)
QQFNSYPRT

SEQ ID NO: 4056 - protein, 16 aa, Homo sapiens
  Heavy chain CDR3 for antibody 2028 (IGHV3-30)
AKHGYSYGYWLGYFDY

SEQ ID NO: 4057 - protein, 10 aa, Homo sapiens
  Light chain CDR3 for antibody 2029 (IGKV1-16)
QQYNSYPLYT

SEQ ID NO: 4058 - protein, 18 aa, Homo sapiens
  Heavy chain CDR3 for antibody 2029 (IGHV5-a)
ARQFPCSSTSCPLGWFDP

SEQ ID NO: 4059 - protein, 9 aa, Homo sapiens
  Light chain CDR3 for antibody 2030 (IGKV2-30)
MQGTHWPPG

SEQ ID NO: 4060 - protein, 12 aa, Homo sapiens
  Heavy chain CDR3 for antibody 2030 (IGHV5-51)
ASTTTPEYPLDP

SEQ ID NO: 4061 - protein, 9 aa, Homo sapiens
  Light chain CDR3 for antibody 2031 (IGKV1-39)
QQSYSPPRT

SEQ ID NO: 4062 - protein, 12 aa, Homo sapiens
  Heavy chain CDR3 for antibody 2031 (IGHV1-46)
ARAPSDYYGMDV

SEQ ID NO: 4063 - protein, 9 aa, Homo sapiens
  Light chain CDR3 for antibody 2032 (IGKV1-39)
HQSYTSPRT

SEQ ID NO: 4064 - protein, 13 aa, Homo sapiens
  Heavy chain CDR3 for antibody 2032 (IGHV4/OR15-8)
ARELESDGRSFDR

SEQ ID NO: 4065 - protein, 10 aa, Homo sapiens
  Light chain CDR3 for antibody 2033 (IGKV1-33)
QQYDNLPPYT

SEQ ID NO: 4066 - protein, 14 aa, Homo sapiens
  Heavy chain CDR3 for antibody 2033 (IGHV3-66)
ARVEFYGGKGAFDI

SEQ ID NO: 4067 - protein, 10 aa, Homo sapiens
  Light chain CDR3 for antibody 2034 (IGKV1-39)
QQSYSTPPFT

SEQ ID NO: 4068 - protein, 16 aa, Homo sapiens
  Heavy chain CDR3 for antibody 2034 (IGHV3-30)
AKHGYSYGYWLGYFDY

SEQ ID NO: 4069 - protein, 10 aa, Homo sapiens
  Light chain CDR3 for antibody 2035 (IGKV3-15)
QQYNNWPPLT

SEQ ID NO: 4070 - protein, 22 aa, Homo sapiens
  Heavy chain CDR3 for antibody 2035 (IGHV4-39)
ARHRTNSITIFGVVTMNNWFDP

SEQ ID NO: 4071 - protein, 9 aa, Homo sapiens
  Light chain CDR3 for antibody 2036 (IGKV1-33)
QQYDNLPRT

SEQ ID NO: 4072 - protein, 14 aa, Homo sapiens
  Heavy chain CDR3 for antibody 2036 (IGHV3-66)
ARVEFYGGKGAFDI

SEQ ID NO: 4073 - protein, 7 aa, Homo sapiens
  Light chain CDR3 for antibody 2037 (IGKV3-20)
QQYGSSP

SEQ ID NO: 4074 - protein, 17 aa, Homo sapiens
  Heavy chain CDR3 for antibody 2037 (IGHV1-69)
ARKGYGLITMIVGPFDI

SEQ ID NO: 4075 - protein, 9 aa, Homo sapiens
  Light chain CDR3 for antibody 2038 (IGKV1-13)
QQFNSYPRT

SEQ ID NO: 4076 - protein, 12 aa, Homo sapiens
  Heavy chain CDR3 for antibody 2038 (IGHV3-66)
ARDCLGIPSMDV

SEQ ID NO: 4077 - protein, 8 aa, Homo sapiens
  Light chain CDR3 for antibody 2039 (IGKV4-1)
QQYYSTRT

SEQ ID NO: 4078 - protein, 16 aa, Homo sapiens
  Heavy chain CDR3 for antibody 2039 (IGHV1-18)
AREASDYYDSSGRLDI

SEQ ID NO: 4079 - protein, 8 aa, Homo sapiens
  Light chain CDR3 for antibody 2040 (IGKV1-5)
QQYNSYSG

SEQ ID NO: 4080 - protein, 24 aa, Homo sapiens
  Heavy chain CDR3 for antibody 2040 (IGHV4-34)
ARAEGRVVPAALGVAYYYYYYMDV

SEQ ID NO: 4081 - protein, 9 aa, Homo sapiens
  Light chain CDR3 for antibody 2041 (IGKV1-13)
QQFNSYPRT

SEQ ID NO: 4082 - protein, 10 aa, Homo sapiens
  Heavy chain CDR3 for antibody 2041 (IGHV3-53)
ARDLASGEGP

SEQ ID NO: 4083 - protein, 9 aa, Homo sapiens
  Light chain CDR3 for antibody 2042 (IGKV1-9)
QQLNSYPFT

SEQ ID NO: 4084 - protein, 18 aa, Homo sapiens
  Heavy chain CDR3 for antibody 2042 (IGHV1-46)
ARVTYGGNPGYYYYGMDV

SEQ ID NO: 4085 - protein, 10 aa, Homo sapiens
  Light chain CDR3 for antibody 2043 (IGKV1-33)
QQYDNLPPYT

SEQ ID NO: 4086 - protein, 19 aa, Homo sapiens
  Heavy chain CDR3 for antibody 2043 (IGHV3-33)
ARDGQGIAAAGTISSAFDI

SEQ ID NO: 4087 - protein, 9 aa, Homo sapiens
  Light chain CDR3 for antibody 2044 (IGKV2D-28)
MQALQTPGT

SEQ ID NO: 4088 - protein, 12 aa, Homo sapiens
  Heavy chain CDR3 for antibody 2044 (IGHV2-5)
AHRRNFLGHFDY

SEQ ID NO: 4089 - protein, 9 aa, Homo sapiens
  Light chain CDR3 for antibody 2045 (IGKV3-20)
QQYGSSPLT

SEQ ID NO: 4090 - protein, 11 aa, Homo sapiens
  Heavy chain CDR3 for antibody 2045 (IGHV1-69)
ASRDTYNWFDP

SEQ ID NO: 4091 - protein, 9 aa, Homo sapiens
  Light chain CDR3 for antibody 2046 (IGKV1-39)
QQSYSTPRT

SEQ ID NO: 4092 - protein, 12 aa, Homo sapiens
  Heavy chain CDR3 for antibody 2046 (IGHV2-70)
ARETVRGVHFDY

SEQ ID NO: 4093 - protein, 9 aa, Homo sapiens
  Light chain CDR3 for antibody 2047 (IGKV1-13)
QQFNSYPRT

SEQ ID NO: 4094 - protein, 12 aa, Homo sapiens
  Heavy chain CDR3 for antibody 2047 (IGHV3-53)
ARDLGYAGGLDY

SEQ ID NO: 4095 - protein, 9 aa, Homo sapiens
  Light chain CDR3 for antibody 2048 (IGKV3-20)
QQYGSSPLT

SEQ ID NO: 4096 - protein, 12 aa, Homo sapiens
  Heavy chain CDR3 for antibody 2048 (IGHV1-69)
ARAPIILHAFDI

SEQ ID NO: 4097 - protein, 10 aa, Homo sapiens
  Light chain CDR3 for antibody 2049 (IGKV1-39)
QQSYSTPPFT

SEQ ID NO: 4098 - protein, 12 aa, Homo sapiens
  Heavy chain CDR3 for antibody 2049 (IGHV3-53)
ARDLGYAGGLDY

SEQ ID NO: 4099 - protein, 9 aa, Homo sapiens
  Light chain CDR3 for antibody 2050 (IGKV3-20)
QQYGSSPLT

SEQ ID NO: 4100 - protein, 17 aa, Homo sapiens
  Heavy chain CDR3 for antibody 2050 (IGHV4-31)
ASSRGGDYGDYSGPFDY

SEQ ID NO: 4101 - protein, 9 aa, Homo sapiens
  Light chain CDR3 for antibody 2051 (IGKV1-39)
QQSYTIPVT

SEQ ID NO: 4102 - protein, 14 aa, Homo sapiens
  Heavy chain CDR3 for antibody 2051 (IGHV4-31)
ARVRAYGDYIYFDN

SEQ ID NO: 4103 - protein, 10 aa, Homo sapiens
  Light chain CDR3 for antibody 2052 (IGKV3-15)
QQYNNWPPLT

SEQ ID NO: 4104 - protein, 19 aa, Homo sapiens
  Heavy chain CDR3 for antibody 2052 (IGHV4-31)
ARVVGHTIFGVVIIQNFDY

SEQ ID NO: 4105 - protein, 10 aa, Homo sapiens [sequence omitted]

SEQ ID NO: 4106 - protein, 15 aa, Homo sapiens
  Heavy chain CDR3 for antibody 2053 (IGHV5-51)
ARLRGERVVTEFFDP

SEQ ID NO: 4107 - protein, 10 aa, Homo sapiens
  Light chain CDR3 for antibody 2054 (IGKV1-39)
QQSYSTPPFT

SEQ ID NO: 4108 - protein, 12 aa, Homo sapiens
  Heavy chain CDR3 for antibody 2054 (IGHV3-66)
ARDCLGIPSMDV

SEQ ID NO: 4109 - protein, 8 aa, Homo sapiens
  Light chain CDR3 for antibody 2055 (IGKV3-20)
QQYGSSPP

SEQ ID NO: 4110 - protein, 18 aa, Homo sapiens
  Heavy chain CDR3 for antibody 2055 (IGHV1-69)
ATPRGYGSGWYVLWAFDI

SEQ ID NO: 4111 - protein, 8 aa, Homo sapiens
  Light chain CDR3 for antibody 2056 (IGKV3-20)
QQYGSSPP

SEQ ID NO: 4112 - protein, 12 aa, Homo sapiens
  Heavy chain CDR3 for antibody 2056 (IGHV1-69)
ARAPIILHAFDI

SEQ ID NO: 4113 - protein, 10 aa, Homo sapiens [sequence omitted]

SEQ ID NO: 4114 - protein, 20 aa, Homo sapiens
  Heavy chain CDR3 for antibody 2057 (IGHV4-34)
ARGSLLRYFDWTYYYYGMDV

SEQ ID NO: 4115 - protein, 9 aa, Homo sapiens
  Light chain CDR3 for antibody 2058 (IGKV1-27)
QKYNSAPRT

SEQ ID NO: 4116 - protein, 12 aa, Homo sapiens
  Heavy chain CDR3 for antibody 2058 (IGHV2-5)
AHRRNFLGHFDY

SEQ ID NO: 4117 - protein, 9 aa, Homo sapiens
  Light chain CDR3 for antibody 2059 (IGKV3-20)
QQYGSSPLT

SEQ ID NO: 4118 - protein, 16 aa, Homo sapiens
  Heavy chain CDR3 for antibody 2059 (IGHV2-26)
AHGYCGAGSCPALFDS

SEQ ID NO: 4119 - protein, 10 aa, Homo sapiens
  Light chain CDR3 for antibody 2060 (IGKV3-11)
QQRSNWPPWT

SEQ ID NO: 4120 - protein, 13 aa, Homo sapiens
  Heavy chain CDR3 for antibody 2060 (IGHV3-11)
AGNDFWSGYYVVY

SEQ ID NO: 4121 - protein, 10 aa, Homo sapiens
  Light chain CDR3 for antibody 2061 (IGKV1-39)
QQSYSTPPFT

SEQ ID NO: 4122 - protein, 10 aa, Homo sapiens
  Heavy chain CDR3 for antibody 2061 (IGHV3-53)
ARDLASGEGP

SEQ ID NO: 4123 - protein, 8 aa, Homo sapiens
  Light chain CDR3 for antibody 2062 (IGKV1-5)
QQYNSYLT

SEQ ID NO: 4124 - protein, 11 aa, Homo sapiens
  Heavy chain CDR3 for antibody 2062 (IGHV1-69)
ASRDTYNWFDP

SEQ ID NO: 4125 - protein, 9 aa, Homo sapiens
  Light chain CDR3 for antibody 2063 (IGKV1-27)
QKYNSAPRT

SEQ ID NO: 4126 - protein, 20 aa, Homo sapiens
  Heavy chain CDR3 for antibody 2063 (IGHV4-34)
ARGSLLRYFDWTYYYYGMDV

SEQ ID NO: 4127 - protein, 9 aa, Homo sapiens
  Light chain CDR3 for antibody 2064 (IGKV3-20)
QQYGSSPLT

SEQ ID NO: 4128 - protein, 15 aa, Homo sapiens
  Heavy chain CDR3 for antibody 2064 (IGHV1-24)
ATGSAVAGHEGWFDP

SEQ ID NO: 4129 - protein, 9 aa, Homo sapiens
  Light chain CDR3 for antibody 2065 (IGKV1-39)
QQSYSTPYT

SEQ ID NO: 4130 - protein, 18 aa, Homo sapiens
  Heavy chain CDR3 for antibody 2065 (IGHV3-11)
ATPRGYGSGWYVLWAFDI

SEQ ID NO: 4131 - protein, 9 aa, Homo sapiens
  Light chain CDR3 for antibody 2066 (IGKV1-12)
QQANSFPFT

SEQ ID NO: 4132 - protein, 19 aa, Homo sapiens
  Heavy chain CDR3 for antibody 2066 (IGHV4-61)
ARERVGVQWPVYYYYGMDV

SEQ ID NO: 4133 - protein, 10 aa, Homo sapiens
  Light chain CDR3 for antibody 2067 (IGKV1-33)
QQYDNLPPYT

SEQ ID NO: 4134 - protein, 16 aa, Homo sapiens
  Heavy chain CDR3 for antibody 2067 (IGHV3-30)
AKHGCSYGCWLGCFDY

SEQ ID NO: 4135 - protein, 10 aa, Homo sapiens
  Light chain CDR3 for antibody 2068 (IGKV3-15)
QQYNNWPPIT

SEQ ID NO: 4136 - protein, 22 aa, Homo sapiens
  Heavy chain CDR3 for antibody 2068 (IGHV4-39)
ARQNSNRITIFGVVKGGNWFDP

SEQ ID NO: 4137 - protein, 9 aa, Homo sapiens
  Light chain CDR3 for antibody 2069 (IGKV1-39)
QQSYDTPRT

SEQ ID NO: 4138 - protein, 19 aa, Homo sapiens
  Heavy chain CDR3 for antibody 2069 (IGHV4-31)
ARVVGHTIFGVVIIQNFDY

SEQ ID NO: 4139 - protein, 10 aa, Homo sapiens
  Light chain CDR3 for antibody 2070 (IGKV1-39)
QQSYSTPPFT

SEQ ID NO: 4140 - protein, 11 aa, Homo sapiens
  Heavy chain CDR3 for antibody 2070 (IGHV3-53)
ARAYGDYYFDY

SEQ ID NO: 4141 - protein, 9 aa, Homo sapiens
  Light chain CDR3 for antibody 2071 (IGKV3-20)
QQYGSSPLT

SEQ ID NO: 4142 - protein, 18 aa, Homo sapiens
  Heavy chain CDR3 for antibody 2071 (IGHV1-69)
ARERYSSGWDYYYYGMDV

SEQ ID NO: 4143 - protein, 10 aa, Homo sapiens
  Light chain CDR3 for antibody 2072 (IGKV1-33)
QQYDNLPPYT

SEQ ID NO: 4144 - protein, 16 aa, Homo sapiens
  Heavy chain CDR3 for antibody 2072 (IGHV1-2)
ARGDVVDPGVALVLDV

SEQ ID NO: 4145 - protein, 10 aa, Homo sapiens
  Light chain CDR3 for antibody 2073 (IGKV1-9)
QQLNSYPPYT

SEQ ID NO: 4146 - protein, 16 aa, Homo sapiens
  Heavy chain CDR3 for antibody 2073 (IGHV3-30)
AKHGYSYGYWLGYFDY

SEQ ID NO: 4147 - protein, 10 aa, Homo sapiens
  Light chain CDR3 for antibody 2074 (IGKV1-33)
QQYDNLPPYT

SEQ ID NO: 4148 - protein, 18 aa, Homo sapiens
  Heavy chain CDR3 for antibody 2074 (IGHV4-34)
ARGTTVTTLYYYYYGMDV

SEQ ID NO: 4149 - protein, 10 aa, Homo sapiens
  Light chain CDR3 for antibody 2075 (IGKV3-20)
QQYGSSPLFT

SEQ ID NO: 4150 - protein, 14 aa, Homo sapiens
  Heavy chain CDR3 for antibody 2075 (IGHV4-61)
ARGCSGGSCYSFGY

SEQ ID NO: 4151 - protein, 9 aa, Homo sapiens
  Light chain CDR3 for antibody 2076 (IGKV3-20)
QQYGSSPLT

SEQ ID NO: 4152 - protein, 16 aa, Homo sapiens
  Heavy chain CDR3 for antibody 2076 (IGHV3-30)
AKHGYSYGYWLGYFDY

SEQ ID NO: 4153 - protein, 10 aa, Homo sapiens
  Light chain CDR3 for antibody 2077 (IGKV1-33)
QQYDNLLLLT

SEQ ID NO: 4154 - protein, 12 aa, Homo sapiens
  Heavy chain CDR3 for antibody 2077 (IGHV5-51)
ASTTTPEYPLDP

SEQ ID NO: 4155 - protein, 9 aa, Homo sapiens
  Light chain CDR3 for antibody 2078 (IGKV1-12)
QQANSFPLT

SEQ ID NO: 4156 - protein, 12 aa, Homo sapiens
  Heavy chain CDR3 for antibody 2078 (IGHV3-53)
ARDLGYAGGLDY

SEQ ID NO: 4157 - protein, 9 aa, Homo sapiens
  Light chain CDR3 for antibody 2079 (IGKV3-20)
QQYGSSPRT

SEQ ID NO: 4158 - protein, 10 aa, Homo sapiens
  Heavy chain CDR3 for antibody 2079 (IGHV1-46)
ARERLRYFDY

SEQ ID NO: 4159 - protein, 9 aa, Homo sapiens
  Light chain CDR3 for antibody 2080 (IGKV1-6)
LQDYNYPRT

SEQ ID NO: 4160 - protein, 14 aa, Homo sapiens
  Heavy chain CDR3 for antibody 2080 (IGHV3-66)
ARVEFYGGKGAFDI

SEQ ID NO: 4161 - protein, 9 aa, Homo sapiens
  Light chain CDR3 for antibody 2081 (IGKV3-20)
QQYGSSPWT

SEQ ID NO: 4162 - protein, 21 aa, Homo sapiens
  Heavy chain CDR3 for antibody 2081 (IGHV4-b)
ARGGRFLEWLLSKNYYYYMDV

SEQ ID NO: 4163 - protein, 9 aa, Homo sapiens
  Light chain CDR3 for antibody 2082 (IGKV3-20)
QQYGSSPLT

SEQ ID NO: 4164 - protein, 19 aa, Homo sapiens
  Heavy chain CDR3 for antibody 2082 (IGHV3-9)
ARGGYCTIGVCLLYNWFDP

SEQ ID NO: 4165 - protein, 9 aa, Homo sapiens
  Light chain CDR3 for antibody 2083 (IGKV1-39)
QQSYSTPPT

SEQ ID NO: 4166 - protein, 19 aa, Homo sapiens
  Heavy chain CDR3 for antibody 2083 (IGHV3-74)
ARALPSDFWSGYFSYYFDY

SEQ ID NO: 4167 - protein, 10 aa, Homo sapiens
  Light chain CDR3 for antibody 2084 (IGKV1-33)
QQHDNLPPYT

SEQ ID NO: 4168 - protein, 11 aa, Homo sapiens
  Heavy chain CDR3 for antibody 2084 (IGHV3-66)
ARDWGDYYFDY

SEQ ID NO: 4169 - protein, 10 aa, Homo sapiens
  Light chain CDR3 for antibody 2085 (IGKV3-20)
QQYGHSPRYS

SEQ ID NO: 4170 - protein, 21 aa, Homo sapiens
  Heavy chain CDR3 for antibody 2085 (IGHV1-2)
AREMYYSDTDGFSIGGNWFDP

SEQ ID NO: 4171 - protein, 9 aa, Homo sapiens
  Light chain CDR3 for antibody 2086 (IGKV1-6)
LQDYNYPRT

SEQ ID NO: 4172 - protein, 10 aa, Homo sapiens
  Heavy chain CDR3 for antibody 2086 (IGHV3-53)
ARDLASGVDH

SEQ ID NO: 4173 - protein, 10 aa, Homo sapiens
  Light chain CDR3 for antibody 2087 (IGKV1-33)
QQYDNLLLLT

SEQ ID NO: 4174 - protein, 12 aa, Homo sapiens
  Heavy chain CDR3 for antibody 2087 (IGHV3-66)
ARDCLGIPSMDV

SEQ ID NO: 4175 - protein, 9 aa, Homo sapiens
  Light chain CDR3 for antibody 2088 (IGKV3-20)
QQYGSSPWT

SEQ ID NO: 4176 - protein, 20 aa, Homo sapiens
  Heavy chain CDR3 for antibody 2088 (IGHV4-39)
ASLSVLRYFDSLFYYYGMDV

SEQ ID NO: 4177 - protein, 9 aa, Homo sapiens
  Light chain CDR3 for antibody 2089 (IGKV3-20)
QQYGSSPLT

SEQ ID NO: 4178 - protein, 11 aa, Homo sapiens
  Heavy chain CDR3 for antibody 2089 (IGHV3-53)
ARAYGDYYFDY

SEQ ID NO: 4179 - protein, 9 aa, Homo sapiens
  Light chain CDR3 for antibody 2090 (IGKV1-33)
QQYDNLPRT

SEQ ID NO: 4180 - protein, 16 aa, Homo sapiens
  Heavy chain CDR3 for antibody 2090 (IGHV1-2)
ARGDVVDPGVALVLDV

SEQ ID NO: 4181 - protein, 10 aa, Homo sapiens
  Light chain CDR3 for antibody 2091 (IGKV1-33)
QQYDNLPPYT

SEQ ID NO: 4182 - protein, 18 aa, Homo sapiens
  Heavy chain CDR3 for antibody 2091 (IGHV3-11)
ATPRGYGSGWYVLWAFDI

SEQ ID NO: 4183 - protein, 9 aa, Homo sapiens
  Light chain CDR3 for antibody 2092 (IGKV3-20)
QQYGSSPLT

SEQ ID NO: 4184 - protein, 18 aa, Homo sapiens
  Heavy chain CDR3 for antibody 2092 (IGHV3-11)
ATPRGYGSGWYVLWAFDI

SEQ ID NO: 4185 - protein, 9 aa, Homo sapiens
  Light chain CDR3 for antibody 2093 (IGKV1-39)
QQSYTIPVT

SEQ ID NO: 4186 - protein, 16 aa, Homo sapiens
  Heavy chain CDR3 for antibody 2093 (IGHV3-21)
ARSTIHIVRGALAFDF

SEQ ID NO: 4187 - protein, 10 aa, Homo sapiens
  Light chain CDR3 for antibody 2094 (IGKV1-33)
QQYDNLLLLT

SEQ ID NO: 4188 - protein, 17 aa, Homo sapiens
  Heavy chain CDR3 for antibody 2094 (IGHV3-11)
ASSRGGDYGDYSGPFDY

SEQ ID NO: 4189 - protein, 10 aa, Homo sapiens
  Light chain CDR3 for antibody 2095 (IGKV1-33)
QQYDNLPPYT

SEQ ID NO: 4190 - protein, 22 aa, Homo sapiens
  Heavy chain CDR3 for antibody 2095 (IGHV3-74)
ARVVDTAMVDGINYYYYYGMDV

SEQ ID NO: 4191 - protein, 8 aa, Homo sapiens
  Light chain CDR3 for antibody 2096 (IGKV1-5)
QQYKSGYT

SEQ ID NO: 4192 - protein, 13 aa, Homo sapiens
  Heavy chain CDR3 for antibody 2096 (IGHV3-49)
TRNDFWGGYYSDY

SEQ ID NO: 4193 - protein, 8 aa, Homo sapiens
  Light chain CDR3 for antibody 2097 (IGKV4-1)
QQYYSTRT

SEQ ID NO: 4194 - protein, 24 aa, Homo sapiens
  Heavy chain CDR3 for antibody 2097 (IGHV4-34)
ARAEGRVVPAALGVAYYYYYYMDV

SEQ ID NO: 4195 - protein, 10 aa, Homo sapiens
  Light chain CDR3 for antibody 2098 (IGKV1-33)
QQYDNLPPYT

SEQ ID NO: 4196 - protein, 19 aa, Homo sapiens
  Heavy chain CDR3 for antibody 2098 (IGHV4-31)
ARVVGHTIFGVVIIQNFDY

SEQ ID NO: 4197 - protein, 9 aa, Homo sapiens
  Light chain CDR3 for antibody 2099 (IGKV1-6)
LQDYNYPLT

SEQ ID NO: 4198 - protein, 11 aa, Homo sapiens
  Heavy chain CDR3 for antibody 2099 (IGHV3-66)
ARDWGDYYFDY

SEQ ID NO: 4199 - protein, 9 aa, Homo sapiens
  Light chain CDR3 for antibody 2100 (IGKV1-6)
LQDYNYPRT

SEQ ID NO: 4200 - protein, 15 aa, Homo sapiens
  Heavy chain CDR3 for antibody 2100 (IGHV3-21)
ARDLGWYLHPIVLDY

SEQ ID NO: 4201 - protein, 9 aa, Homo sapiens
  Light chain CDR3 for antibody 2101 (IGKV1-13)
QQFNSYPRT

SEQ ID NO: 4202 - protein, 14 aa, Homo sapiens
  Heavy chain CDR3 for antibody 2101 (IGHV3-66)
ARVEFYGGKGAFDI

SEQ ID NO: 4203 - protein, 10 aa, Homo sapiens
  Light chain CDR3 for antibody 2102 (IGKV3-20)
QQYGSSPPGT

SEQ ID NO: 4204 - protein, 20 aa, Homo sapiens
  Heavy chain CDR3 for antibody 2102 (IGHV1-18)
ARDLTGYYDFWSGYSYYFDY

SEQ ID NO: 4205 - protein, 11 aa, Homo sapiens
  Light chain CDR3 for antibody 2103 (IGKV1-9)
QQLNSYPPGDT

SEQ ID NO: 4206 - protein, 14 aa, Homo sapiens
  Heavy chain CDR3 for antibody 2103 (IGHV3-66)
ARVEFYGGKGAFDI

SEQ ID NO: 4207 - protein, 9 aa, Homo sapiens
  Light chain CDR3 for antibody 2104 (IGKV1-33)
QQYDNLPRT

SEQ ID NO: 4208 - protein, 18 aa, Homo sapiens
  Heavy chain CDR3 for antibody 2104 (IGHV3-11)
ATPRGYGSGWYVLWAFDI

SEQ ID NO: 4209 - protein, 9 aa, Homo sapiens
  Light chain CDR3 for antibody 2105 (IGKV1-39)
QQSYSTPYT

SEQ ID NO: 4210 - protein, 17 aa, Homo sapiens
  Heavy chain CDR3 for antibody 2105 (IGHV4-31)
ASSRGGDYGDYSGPFDY

SEQ ID NO: 4211 - protein, 9 aa, Homo sapiens
  Light chain CDR3 for antibody 2106 (IGKV1-9)
QQLNNYPVT

SEQ ID NO: 4212 - protein, 13 aa, Homo sapiens
  Heavy chain CDR3 for antibody 2106 (IGHV4-59)
TRAPISTLNWFDP

SEQ ID NO: 4213 - protein, 8 aa, Homo sapiens
  Light chain CDR3 for antibody 2107 (IGKV4-1)
QQYYSTRT

SEQ ID NO: 4214 - protein, 20 aa, Homo sapiens
  Heavy chain CDR3 for antibody 2107 (IGHV4-34)
ARGSLLRYFDWTYYYYGMDV

SEQ ID NO: 4215 - protein, 8 aa, Homo sapiens
  Light chain CDR3 for antibody 2108 (IGKV3-20)
QQYGSSPP

SEQ ID NO: 4216 - protein, 11 aa, Homo sapiens
  Heavy chain CDR3 for antibody 2108 (IGHV3-53)
ARAYGDYYFDY

SEQ ID NO: 4217 - protein, 6 aa, Homo sapiens
  Light chain CDR3 for antibody 2109 (IGKV3-20)
QQSTYT

SEQ ID NO: 4218 - protein, 13 aa, Homo sapiens
  Heavy chain CDR3 for antibody 2109 (IGHV4-61)
ARDGPGEYYYFDY

SEQ ID NO: 4219 - protein, 10 aa, Homo sapiens
  Light chain CDR3 for antibody 2110 (IGKV3-20)
QQYGSSSGWT

SEQ ID NO: 4220 - protein, 14 aa, Homo sapiens
  Heavy chain CDR3 for antibody 2110 (IGHV2-5)
AHRPRLGTPSVFDY

SEQ ID NO: 4221 - protein, 10 aa, Homo sapiens
  Light chain CDR3 for antibody 2111 (IGKV1-33)
QQYDNLPPYT

SEQ ID NO: 4222 - protein, 15 aa, Homo sapiens
  Heavy chain CDR3 for antibody 2111 (IGHV4-61)
ASSWGYGSGSYYSDY

SEQ ID NO: 4223 - protein, 6 aa, Homo sapiens
  Light chain CDR3 for antibody 2112 (IGKV3-20)
QQSTYT

SEQ ID NO: 4224 - protein, 14 aa, Homo sapiens
  Heavy chain CDR3 for antibody 2112 (IGHV3-66)
ARVEFYGGKGAFDI

SEQ ID NO: 4225 - protein, 10 aa, Homo sapiens
  Light chain CDR3 for antibody 2113 (IGKV3-11)
QQRSNWPPWT

SEQ ID NO: 4226 - protein, 11 aa, Homo sapiens
  Heavy chain CDR3 for antibody 2113 (IGHV3-53)
ARAYGDYYFDY

SEQ ID NO: 4227 - protein, 9 aa, Homo sapiens
  Light chain CDR3 for antibody 2114 (IGKV3-20)
QQYGSSPLT

SEQ ID NO: 4228 - protein, 20 aa, Homo sapiens
  Heavy chain CDR3 for antibody 2114 (IGHV4-61)
ARDSLGVVLPNYYYYYGMDV

SEQ ID NO: 4229 - protein, 9 aa, Homo sapiens
  Light chain CDR3 for antibody 2115 (IGKV1-6)
LQDYNYPRT

SEQ ID NO: 4230 - protein, 19 aa, Homo sapiens
  Heavy chain CDR3 for antibody 2115 (IGHV3-33)
ARDGQGIAAAGTISSAFDI

SEQ ID NO: 4231 - protein, 6 aa, Homo sapiens
  Light chain CDR3 for antibody 2116 (IGKV3-20)
QQSTYT

SEQ ID NO: 4232 - protein, 19 aa, Homo sapiens
  Heavy chain CDR3 for antibody 2116 (IGHV4-31)
ARVVGHTIFGVVIIQNFDY

SEQ ID NO: 4233 - protein, 9 aa, Homo sapiens
  Light chain CDR3 for antibody 2117 (IGKV2D-28)
MQARQTPFT

SEQ ID NO: 4234 - protein, 8 aa, Homo sapiens
  Heavy chain CDR3 for antibody 2117 (IGHV3-53)
ARDVGGSA

SEQ ID NO: 4235 - protein, 9 aa, Homo sapiens
  Light chain CDR3 for antibody 2118 (IGKV1-39)
QQSYSTPLT

SEQ ID NO: 4236 - protein, 12 aa, Homo sapiens
  Heavy chain CDR3 for antibody 2118 (IGHV3-66)
ARDCLGIPSMDV

SEQ ID NO: 4237 - protein, 10 aa, Homo sapiens
  Light chain CDR3 for antibody 2119 (IGKV1-33)
QQYDNLPPYT

SEQ ID NO: 4238 - protein, 22 aa, Homo sapiens
  Heavy chain CDR3 for antibody 2119 (IGHV1-69)
ARGGWGTSSSWGPSYYYYYMDV

SEQ ID NO: 4239 - protein, 9 aa, Homo sapiens
  Light chain CDR3 for antibody 2120 (IGKV3-20)
QQYGSSPRT

SEQ ID NO: 4240 - protein, 17 aa, Homo sapiens
  Heavy chain CDR3 for antibody 2120 (IGHV3-23)
AKDRTITIFGVVKALDP

SEQ ID NO: 4241 - protein, 11 aa, Homo sapiens
  Light chain CDR3 for antibody 2121 (IGKV1-9)
QQLNSYPPGDT

SEQ ID NO: 4242 - protein, 19 aa, Homo sapiens
  Heavy chain CDR3 for antibody 2121 (IGHV3-33)
ARDGQGIAAAGTISSAFDI

SEQ ID NO: 4243 - protein, 8 aa, Homo sapiens
  Light chain CDR3 for antibody 2122 (IGKV3-20)
QQYGSSPP

SEQ ID NO: 4244 - protein, 14 aa, Homo sapiens
  Heavy chain CDR3 for antibody 2122 (IGHV3-21)
AKDPGVIVVVNFQH

SEQ ID NO: 4245 - protein, 6 aa, Homo sapiens
  Light chain CDR3 for antibody 2123 (IGKV3-20)
QQSTYT

SEQ ID NO: 4246 - protein, 15 aa, Homo sapiens
  Heavy chain CDR3 for antibody 2123 (IGHV4-61)
ASSWGYGSGSYYSDY

SEQ ID NO: 4247 - protein, 10 aa, Homo sapiens
  Light chain CDR3 for antibody 2124 (IGKV1-33)
QQYDNLLLLT

SEQ ID NO: 4248 - protein, 12 aa, Homo sapiens
  Heavy chain CDR3 for antibody 2124 (IGHV3-53)
ARDLGYAGGLDY

SEQ ID NO: 4249 - protein, 10 aa, Homo sapiens
  Light chain CDR3 for antibody 2125 (IGKV1-33)
QQHDNLPPYT

SEQ ID NO: 4250 - protein, 16 aa, Homo sapiens
  Heavy chain CDR3 for antibody 2125 (IGHV3-30)
AKQGCSYGYWLGYFDY

SEQ ID NO: 4251 - protein, 9 aa, Homo sapiens
  Light chain CDR3 for antibody 2126 (IGKV1-16)
QQYNSYPRT

SEQ ID NO: 4252 - protein, 17 aa, Homo sapiens
  Heavy chain CDR3 for antibody 2126 (IGHV4-31)
ASSRGGDYGDYSGPFDY

SEQ ID NO: 4253 - protein, 9 aa, Homo sapiens
  Light chain CDR3 for antibody 2127 (IGKV1-27)
QKYNSATWT

SEQ ID NO: 4254 - protein, 20 aa, Homo sapiens
  Heavy chain CDR3 for antibody 2127 (IGHV3-11)
ARTDVAYDFWSGYIAVRHDY

SEQ ID NO: 4255 - protein, 10 aa, Homo sapiens
  Light chain CDR3 for antibody 2128 (IGKV2-30)
MQGTHWPPLT

SEQ ID NO: 4256 - protein, 6 aa, Homo sapiens
  Heavy chain CDR3 for antibody 2128 (IGHV3-48)
ARDWHY

SEQ ID NO: 4257 - protein, 9 aa, Homo sapiens
  Light chain CDR3 for antibody 2129 (IGKV1-39)
QQSYSTPLT

SEQ ID NO: 4258 - protein, 16 aa, Homo sapiens
  Heavy chain CDR3 for antibody 2129 (IGHV3-30)
AKHGYSYGYWLGYFDY

SEQ ID NO: 4259 - protein, 9 aa, Homo sapiens
  Light chain CDR3 for antibody 2130 (IGKV3-20)
QQYGSSPRT

SEQ ID NO: 4260 - protein, 12 aa, Homo sapiens
  Heavy chain CDR3 for antibody 2130 (IGHV3-66)
ARDCLGIPSMDV

SEQ ID NO: 4261 - protein, 6 aa, Homo sapiens
  Light chain CDR3 for antibody 2131 (IGKV3-20)
QQSTYT

SEQ ID NO: 4262 - protein, 19 aa, Homo sapiens
  Heavy chain CDR3 for antibody 2131 (IGHV3-33)
ARDGQGIAAAGTISSAFDI

SEQ ID NO: 4263 - protein, 9 aa, Homo sapiens
  Light chain CDR3 for antibody 2132 (IGKV3-20)
QQLGTSSWT

SEQ ID NO: 4264 - protein, 11 aa, Homo sapiens
  Heavy chain CDR3 for antibody 2132 (IGHV3-74)
ARGGFNHAFDL

SEQ ID NO: 4265 - protein, 9 aa, Homo sapiens
  Light chain CDR3 for antibody 2133 (IGKV1-39)
QQSYSTPWT

SEQ ID NO: 4266 - protein, 15 aa, Homo sapiens
  Heavy chain CDR3 for antibody 2133 (IGHV3-30)
ARDGRDGYNRGAFDI

SEQ ID NO: 4267 - protein, 6 aa, Homo sapiens
  Light chain CDR3 for antibody 2134 (IGKV3-20)
QQSTYT

SEQ ID NO: 4268 - protein, 16 aa, Homo sapiens
  Heavy chain CDR3 for antibody 2134 (IGHV1-2)
ARGDVVDPGVALVLDV

SEQ ID NO: 4269 - protein, 9 aa, Homo sapiens
  Light chain CDR3 for antibody 2135 (IGKV1-33)
QQYDNLPRT

SEQ ID NO: 4270 - protein, 17 aa, Homo sapiens
  Heavy chain CDR3 for antibody 2135 (IGHV4-31)
ASSRGGDYGDYSGPFDY

SEQ ID NO: 4271 - protein, 10 aa, Homo sapiens
  Light chain CDR3 for antibody 2136 (IGKV1-33)
QQYDNLPPYT

SEQ ID NO: 4272 - protein, 12 aa, Homo sapiens
  Heavy chain CDR3 for antibody 2136 (IGHV2-5)
AHRRNFLGHFDY

SEQ ID NO: 4273 - protein, 10 aa, Homo sapiens
  Light chain CDR3 for antibody 2137 (IGKV1-33)
QQYDNLPPYT

SEQ ID NO: 4274 - protein, 16 aa, Homo sapiens
  Heavy chain CDR3 for antibody 2137 (IGHV3-66)
AEQGYSYGYWLGDFDY

SEQ ID NO: 4275 - protein, 6 aa, Homo sapiens
  Light chain CDR3 for antibody 2138 (IGKV3-20)
QQSTYT

SEQ ID NO: 4276 - protein, 12 aa, Homo sapiens
  Heavy chain CDR3 for antibody 2138 (IGHV2-5)
AHRRNFLGHFDY

SEQ ID NO: 4277 - protein, 8 aa, Homo sapiens
  Light chain CDR3 for antibody 2139 (IGKV1-5)
QQYNSYSG

SEQ ID NO: 4278 - protein, 12 aa, Homo sapiens
  Heavy chain CDR3 for antibody 2139 (IGHV1-69)
ARAPIILHAFDI

SEQ ID NO: 4279 - protein, 10 aa, Homo sapiens
  Light chain CDR3 for antibody 2140 (IGKV1-33)
QQYDNLLLLT

SEQ ID NO: 4280 - protein, 16 aa, Homo sapiens
  Heavy chain CDR3 for antibody 2140 (IGHV3-30)
AKHGYSYGYWLGYFDY

SEQ ID NO: 4281 - protein, 9 aa, Homo sapiens
  Light chain CDR3 for antibody 2141 (IGKV1-13)
QQFNSYPRT

SEQ ID NO: 4282 - protein, 19 aa, Homo sapiens
  Heavy chain CDR3 for antibody 2141 (IGHV3-33)
ARDGQGIAAAGTISSAFDI

SEQ ID NO: 4283 - protein, 10 aa, Homo sapiens
  Light chain CDR3 for antibody 2142 (IGKV1-33)
QQYDNLLLLT

SEQ ID NO: 4284 - protein, 11 aa, Homo sapiens
  Heavy chain CDR3 for antibody 2142 (IGHV3-71)
ARDPGWGYFDY

SEQ ID NO: 4285 - protein, 10 aa, Homo sapiens
  Light chain CDR3 for antibody 2143 (IGKV1-33)
QQHDNLPPYT

SEQ ID NO: 4286 - protein, 16 aa, Homo sapiens
  Heavy chain CDR3 for antibody 2143 (IGHV3-30)
AKHGYSDGDWLGYVDY

SEQ ID NO: 4287 - protein, 9 aa, Homo sapiens
  Light chain CDR3 for antibody 2144 (IGKV1-39)
QQSYSTPWT

SEQ ID NO: 4288 - protein, 20 aa, Homo sapiens
  Heavy chain CDR3 for antibody 2144 (IGHV4-34)
ARTHPPDDFWSGYRNRYFDY

SEQ ID NO: 4289 - protein, 10 aa, Homo sapiens
  Light chain CDR3 for antibody 2145 (IGKV1-33)
QQYDNLPPYT

SEQ ID NO: 4290 - protein, 16 aa, Homo sapiens
  Heavy chain CDR3 for antibody 2145 (IGHV3-64)
AKHGYIYAYCLCYFDY

SEQ ID NO: 4291 - protein, 10 aa, Homo sapiens
  Light chain CDR3 for antibody 2146 (IGKV1-33)
QQYDNLLLLT

SEQ ID NO: 4292 - protein, 18 aa, Homo sapiens
  Heavy chain CDR3 for antibody 2146 (IGHV4-34)
ARGGTVTTFYYYYYGMDV

SEQ ID NO: 4293 - protein, 9 aa, Homo sapiens
  Light chain CDR3 for antibody 2147 (IGKV1-13)
QQFNSYPRT

SEQ ID NO: 4294 - protein, 16 aa, Homo sapiens
  Heavy chain CDR3 for antibody 2147 (IGHV1-2)
ARGDVVDPGVALVLDV

SEQ ID NO: 4295 - protein, 9 aa, Homo sapiens
  Light chain CDR3 for antibody 2148 (IGKV1-6)
LQDYNYPLT

SEQ ID NO: 4296 - protein, 10 aa, Homo sapiens
  Heavy chain CDR3 for antibody 2148 (IGHV3-53)
ARDLAYGVDA

SEQ ID NO: 4297 - protein, 10 aa, Homo sapiens
  Light chain CDR3 for antibody 2149 (IGKV1-9)
QQLNSYPPYT

SEQ ID NO: 4298 - protein, 12 aa, Homo sapiens
  Heavy chain CDR3 for antibody 2149 (IGHV3-66)
ARDCLGIPSMDV

SEQ ID NO: 4299 - protein, 9 aa, Homo sapiens
  Light chain CDR3 for antibody 2150 (IGKV1-12)
QQANSFPFT

SEQ ID NO: 4300 - protein, 19 aa, Homo sapiens
  Heavy chain CDR3 for antibody 2150 (IGHV4-b)
ARVVGHTIFGVVIIQNFDY

SEQ ID NO: 4301 - protein, 10 aa, Homo sapiens
  Light chain CDR3 for antibody 2151 (IGKV1-33)
QQYDNLPPYT

SEQ ID NO: 4302 - protein, 16 aa, Homo sapiens
  Heavy chain CDR3 for antibody 2151 (IGHV3-30)
AKQGCRYGYWLGYFDD

SEQ ID NO: 4303 - protein, 9 aa, Homo sapiens
  Light chain CDR3 for antibody 2152 (IGKV1-6)
LQDYNYPRT

SEQ ID NO: 4304 - protein, 12 aa, Homo sapiens
  Heavy chain CDR3 for antibody 2152 (IGHV5-51)
ASTTTPEYPLDP

SEQ ID NO: 4305 - protein, 6 aa, Homo sapiens
  Light chain CDR3 for antibody 2153 (IGKV3-20)
QQSTYT

SEQ ID NO: 4306 - protein, 22 aa, Homo sapiens
  Heavy chain CDR3 for antibody 2153 (IGHV1-69)
ARGGWGTSSSWGPSYYYYYMDV

SEQ ID NO: 4307 - protein, 9 aa, Homo sapiens
  Light chain CDR3 for antibody 2154 (IGKV1-33)
QQYDNLPRT

SEQ ID NO: 4308 - protein, 12 aa, Homo sapiens
  Heavy chain CDR3 for antibody 2154 (IGHV3-30)
GRDCLGVASMDV

SEQ ID NO: 4309 - protein, 9 aa, Homo sapiens
  Light chain CDR3 for antibody 2155 (IGKV1-5)
QQYNSYSLA

SEQ ID NO: 4310 - protein, 12 aa, Homo sapiens
  Heavy chain CDR3 for antibody 2155 (IGHV1-69)
ARREIVVGAFDI

SEQ ID NO: 4311 - protein, 10 aa, Homo sapiens
  Light chain CDR3 for antibody 2156 (IGKV1-33)
QQYDNLPPYT

SEQ ID NO: 4312 - protein, 20 aa, Homo sapiens
  Heavy chain CDR3 for antibody 2156 (IGHV5-a)
ARRGKQWLAGYYYYYYYMDV

SEQ ID NO: 4313 - protein, 9 aa, Homo sapiens
  Light chain CDR3 for antibody 2157 (IGKV1-6)
LQNKDAAWT

SEQ ID NO: 4314 - protein, 10 aa, Homo sapiens
  Heavy chain CDR3 for antibody 2157 (IGHV3-53)
ARDLASGEGP

SEQ ID NO: 4315 - protein, 8 aa, Homo sapiens
  Light chain CDR3 for antibody 2158 (IGKV4-1)
QQYYSTRT

SEQ ID NO: 4316 - protein, 12 aa, Homo sapiens
  Heavy chain CDR3 for antibody 2158 (IGHV3-66)
ARDCLGIPSMDV

SEQ ID NO: 4317 - protein, 10 aa, Homo sapiens
  Light chain CDR3 for antibody 2159 (IGKV1-33)
QQYDNLPPYT

SEQ ID NO: 4318 - protein, 16 aa, Homo sapiens
  Heavy chain CDR3 for antibody 2159 (IGHV3-d)
AKHGCRYGYWLCYFDY

SEQ ID NO: 4319 - protein, 10 aa, Homo sapiens
  Light chain CDR3 for antibody 2160 (IGKV1-33)
QQYDNLLLLT

SEQ ID NO: 4320 - protein, 15 aa, Homo sapiens
  Heavy chain CDR3 for antibody 2160 (IGHV3-21)
ARDLGWYLHPIVLDY

SEQ ID NO: 4321 - protein, 9 aa, Homo sapiens
  Light chain CDR3 for antibody 2161 (IGKV3-11)
QQRSNWPLT

SEQ ID NO: 4322 - protein, 24 aa, Homo sapiens
  Heavy chain CDR3 for antibody 2161 (IGHV3-30)
ARDIRDPGVLLWFGESDYYYGMDV

SEQ ID NO: 4323 - protein, 6 aa, Homo sapiens
  Light chain CDR3 for antibody 2162 (IGKV3-20)
QQSTYT

SEQ ID NO: 4324 - protein, 18 aa, Homo sapiens
  Heavy chain CDR3 for antibody 2162 (IGHV4-34)
ARGTTVTTLYYYYYGMDV

SEQ ID NO: 4325 - protein, 9 aa, Homo sapiens
  Light chain CDR3 for antibody 2163 (IGKV1-33)
QQYDNLPRT

SEQ ID NO: 4326 - protein, 22 aa, Homo sapiens
  Heavy chain CDR3 for antibody 2163 (IGHV3-74)
ARVVDTAMVDGINYYYYYGMDV

SEQ ID NO: 4327 - protein, 10 aa, Homo sapiens
  Light chain CDR3 for antibody 2164 (IGKV1-33)
QQYDNLPPYT

SEQ ID NO: 4328 - protein, 16 aa, Homo sapiens
  Heavy chain CDR3 for antibody 2164 (IGHV3-64)
AKHGCSCGYWLGYFDY

SEQ ID NO: 4329 - protein, 8 aa, Homo sapiens
  Light chain CDR3 for antibody 2165 (IGKV4-1)
QQYYSTRT

SEQ ID NO: 4330 - protein, 17 aa, Homo sapiens
  Heavy chain CDR3 for antibody 2165 (IGHV4-31)
ARDPRGWLQSEWGAFDI

SEQ ID NO: 4331 - protein, 9 aa, Homo sapiens
  Light chain CDR3 for antibody 2166 (IGKV3-11)
QQYYSYPYT

SEQ ID NO: 4332 - protein, 14 aa, Homo sapiens
  Heavy chain CDR3 for antibody 2166 (IGHV3-23)
AKDPGVIVVVNFQH

SEQ ID NO: 4333 - protein, 8 aa, Homo sapiens
  Light chain CDR3 for antibody 2167 (IGKV4-1)
QQYYSTRT

SEQ ID NO: 4334 - protein, 10 aa, Homo sapiens
  Heavy chain CDR3 for antibody 2167 (IGHV3-53)
ARDLASGEGP

SEQ ID NO: 4335 - protein, 9 aa, Homo sapiens
  Light chain CDR3 for antibody 2168 (IGKV1-39)
QQSYSTPLT

SEQ ID NO: 4336 - protein, 11 aa, Homo sapiens
  Heavy chain CDR3 for antibody 2168 (IGHV3-66)
ARDWGDYYFDY

SEQ ID NO: 4337 - protein, 10 aa, Homo sapiens
  Light chain CDR3 for antibody 2169 (IGKV3-15)
QQYNNWPPLT

SEQ ID NO: 4338 - protein, 20 aa, Homo sapiens
  Heavy chain CDR3 for antibody 2169 (IGHV4-61)
ARDSLGVVLPNYYYYYGMDV

SEQ ID NO: 4339 - protein, 10 aa, Homo sapiens
  Light chain CDR3 for antibody 2170 (IGKV1-33)
QQHDNLPPYT

SEQ ID NO: 4340 - protein, 17 aa, Homo sapiens
  Heavy chain CDR3 for antibody 2170 (IGHV4-31)
ASSRGGDYGDYSGPFDY

SEQ ID NO: 4341 - protein, 10 aa, Homo sapiens
  Light chain CDR3 for antibody 2171 (IGKV1-33)
QQYDNLPPYT

SEQ ID NO: 4342 - protein, 16 aa, Homo sapiens
  Heavy chain CDR3 for antibody 2171 (IGHV3-30)
AKHGYSYGDWLGDFDY

SEQ ID NO: 4343 - protein, 11 aa, Homo sapiens
  Light chain CDR3 for antibody 2172 (IGKV3-20)
QQYGSSPPALT

SEQ ID NO: 4344 - protein, 22 aa, Homo sapiens
  Heavy chain CDR3 for antibody 2172 (IGHV4-39)
ARHRTNSITIFGVVTMNNWFDP

SEQ ID NO: 4345 - protein, 10 aa, Homo sapiens
  Light chain CDR3 for antibody 2173 (IGKV1-33)
QQHDNLPPYT

SEQ ID NO: 4346 - protein, 16 aa, Homo sapiens
  Heavy chain CDR3 for antibody 2173 (IGHV3-30)
AKHGYSYGYWLDYFDY

SEQ ID NO: 4347 - protein, 9 aa, Homo sapiens
  Light chain CDR3 for antibody 2174 (IGKV1-33)
QQYDNLPRT

SEQ ID NO: 4348 - protein, 18 aa, Homo sapiens
  Heavy chain CDR3 for antibody 2174 (IGHV1-69)
AREIVLMVYAPPIGAFDI

SEQ ID NO: 4349 - protein, 9 aa, Homo sapiens
  Light chain CDR3 for antibody 2175 (IGKV1-13)
QQFNSYPRT

SEQ ID NO: 4350 - protein, 12 aa, Homo sapiens
  Heavy chain CDR3 for antibody 2175 (IGHV2-5)
AHRRNFLGHFDY

SEQ ID NO: 4351 - protein, 9 aa, Homo sapiens
  Light chain CDR3 for antibody 2176 (IGKV1-33)
QQYDNLPRT

SEQ ID NO: 4352 - protein, 18 aa, Homo sapiens
  Heavy chain CDR3 for antibody 2176 (IGHV4-34)
ARGTTVTTLYYYYYGMDV

SEQ ID NO: 4353 - protein, 8 aa, Homo sapiens
  Light chain CDR3 for antibody 2177 (IGKV4-1)
QQYYSTRT

SEQ ID NO: 4354 - protein, 11 aa, Homo sapiens
  Heavy chain CDR3 for antibody 2177 (IGHV3-66)
ARAYGDYYFDY

SEQ ID NO: 4355 - protein, 8 aa, Homo sapiens
  Light chain CDR3 for antibody 2178 (IGKV4-1)
QQYYSTRT

SEQ ID NO: 4356 - protein, 19 aa, Homo sapiens
  Heavy chain CDR3 for antibody 2178 (IGHV4-31)
ARVVGHTIFGVVIIQNFDY

SEQ ID NO: 4357 - protein, 9 aa, Homo sapiens
  Light chain CDR3 for antibody 2179 (IGKV1-6)
LQDYNYPRT

SEQ ID NO: 4358 - protein, 22 aa, Homo sapiens
  Heavy chain CDR3 for antibody 2179 (IGHV3-74)
ARVVDTAMVDGINYYYYYGMDV

SEQ ID NO: 4359 - protein, 10 aa, Homo sapiens
  Light chain CDR3 for antibody 2180 (IGKV1-33)
QQYDNLLLLT

SEQ ID NO: 4360 - protein, 19 aa, Homo sapiens
  Heavy chain CDR3 for antibody 2180 (IGHV4-61)
AREGYYDSSGYFSRGGFDY

SEQ ID NO: 4361 - protein, 9 aa, Homo sapiens
  Light chain CDR3 for antibody 2181 (IGKV1-33)
QQYDNLPRT

SEQ ID NO: 4362 - protein, 19 aa, Homo sapiens
  Heavy chain CDR3 for antibody 2181 (IGHV4-31)
ARVVGHTIFGVVIIQNFDY

SEQ ID NO: 4363 - protein, 9 aa, Homo sapiens
  Light chain CDR3 for antibody 2182 (IGKV1-33)
QQYDNLPRT

SEQ ID NO: 4364 - protein, 20 aa, Homo sapiens
  Heavy chain CDR3 for antibody 2182 (IGHV5-a)
ARRGKQWLAGYYYYYYYIDV

SEQ ID NO: 4365 - protein, 10 aa, Homo sapiens
  Light chain CDR3 for antibody 2183 (IGKV1-33)
QQYDNLPPYT

SEQ ID NO: 4366 - protein, 16 aa, Homo sapiens
  Heavy chain CDR3 for antibody 2183 (IGHV3-64)
AKHGYSYCYWFGYFDY

SEQ ID NO: 4367 - protein, 9 aa, Homo sapiens
  Light chain CDR3 for antibody 2184 (IGKV1-6)
LQDYNYPRT

SEQ ID NO: 4368 - protein, 20 aa, Homo sapiens
  Heavy chain CDR3 for antibody 2184 (IGHV5-a)
ARRGKQWLAGYYYYYYYMDV

SEQ ID NO: 4369 - protein, 9 aa, Homo sapiens
  Light chain CDR3 for antibody 2185 (IGKV1-33)
QQYDNLPFT

SEQ ID NO: 4370 - protein, 11 aa, Homo sapiens
  Heavy chain CDR3 for antibody 2185 (IGHV3-66)
ARDWGDYYFDY

SEQ ID NO: 4371 - protein, 8 aa, Homo sapiens
  Light chain CDR3 for antibody 2186 (IGKV3-20)
QQYGSSRT

SEQ ID NO: 4372 - protein, 12 aa, Homo sapiens
  Heavy chain CDR3 for antibody 2186 (IGHV1-69)
ATYSTSWHVTDY

SEQ ID NO: 4373 - protein, 9 aa, Homo sapiens
  Light chain CDR3 for antibody 2187 (IGKV3-20)
QQYDSSPRT

SEQ ID NO: 4374 - protein, 11 aa, Homo sapiens
  Heavy chain CDR3 for antibody 2187 (IGHV3-66)
ARDYGDFYSDY

SEQ ID NO: 4375 - protein, 9 aa, Homo sapiens
  Light chain CDR3 for antibody 2188 (IGKV1-33)
QQYGDLPYS

SEQ ID NO: 4376 - protein, 11 aa, Homo sapiens
  Heavy chain CDR3 for antibody 2188 (IGHV3-53)
ARDRPGGLHDY

SEQ ID NO: 4377 - protein, 9 aa, Homo sapiens
  Light chain CDR3 for antibody 2189 (IGKV4-1)
QQYYSTPPT

SEQ ID NO: 4378 - protein, 14 aa, Homo sapiens
  Heavy chain CDR3 for antibody 2189 (IGHV3-h)
ARARTTLQLELFDY

SEQ ID NO: 4379 - protein, 9 aa, Homo sapiens
  Light chain CDR3 for antibody 2190 (IGKV3-20)
QQYGSSPWT

SEQ ID NO: 4380 - protein, 12 aa, Homo sapiens
  Heavy chain CDR3 for antibody 2190 (IGHV1-69)
ATYSTSWHVTDY

SEQ ID NO: 4381 - protein, 9 aa, Homo sapiens
  Light chain CDR3 for antibody 2191 (IGKV1-39)
QQSYSTPLT

SEQ ID NO: 4382 - protein, 11 aa, Homo sapiens
  Heavy chain CDR3 for antibody 2191 (IGHV3-66)
ARDYGDFYSDY

SEQ ID NO: 4383 - protein, 8 aa, Homo sapiens
  Light chain CDR3 for antibody 2192 (IGKV3-20)
QQYGSSRT

SEQ ID NO: 4384 - protein, 16 aa, Homo sapiens
  Heavy chain CDR3 for antibody 2192 (IGHV1-58)
AAPYCSSTSCHDAFDI

SEQ ID NO: 4385 - protein, 9 aa, Homo sapiens
  Light chain CDR3 for antibody 2193 (IGKV3-20)
QQYGSSPRT

SEQ ID NO: 4386 - protein, 11 aa, Homo sapiens
  Heavy chain CDR3 for antibody 2193 (IGHV3-53)
ARDYGDYYFDY

SEQ ID NO: 4387 - protein, 9 aa, Homo sapiens
  Light chain CDR3 for antibody 2194 (IGKV1-12)
QQGNSLPPS

SEQ ID NO: 4388 - protein, 11 aa, Homo sapiens
  Heavy chain CDR3 for antibody 2194 (IGHV3-66)
ARDYGDFYSDY

SEQ ID NO: 4389 - protein, 9 aa, Homo sapiens
  Light chain CDR3 for antibody 2195 (IGKV1-33)
QQYDNLPLT

SEQ ID NO: 4390 - protein, 19 aa, Homo sapiens
  Heavy chain CDR3 for antibody 2195 (IGHV1-8)
ATPRGDSSGWYGYYYGMDV

SEQ ID NO: 4391 - protein, 9 aa, Homo sapiens
  Light chain CDR3 for antibody 2196 (IGKV1-33)
QQYDQRPPT

SEQ ID NO: 4392 - protein, 11 aa, Homo sapiens
  Heavy chain CDR3 for antibody 2196 (IGHV1-2)
AGALVNPTLDR

SEQ ID NO: 4393 - protein, 9 aa, Homo sapiens
  Light chain CDR3 for antibody 2197 (IGKV1-39)
QQSYSTPLT

SEQ ID NO: 4394 - protein, 8 aa, Homo sapiens
  Heavy chain CDR3 for antibody 2197 (IGHV1-69)
ATGPSDSG

SEQ ID NO: 4395 - protein, 9 aa, Homo sapiens
  Light chain CDR3 for antibody 2198 (IGKV3-20)
QQYGSSPQN

SEQ ID NO: 4396 - protein, 11 aa, Homo sapiens
  Heavy chain CDR3 for antibody 2198 (IGHV4-59)
GSNEFWGTSSY

SEQ ID NO: 4397 - protein, 9 aa, Homo sapiens
  Light chain CDR3 for antibody 2199 (IGKV1-5)
QQYNTYSWT

SEQ ID NO: 4398 - protein, 9 aa, Homo sapiens
  Heavy chain CDR3 for antibody 2199 (IGHV3-53)
ASGQGDSLL

SEQ ID NO: 4399 - protein, 9 aa, Homo sapiens
  Light chain CDR3 for antibody 2200 (IGKV1-5)
QQYLSYPWT

SEQ ID NO: 4400 - protein, 14 aa, Homo sapiens
  Heavy chain CDR3 for antibody 2200 (IGHV3-48)
ARDRRDGGYPNCDR

SEQ ID NO: 4401 - protein, 10 aa, Homo sapiens
  Light chain CDR3 for antibody 2201 (IGKV1-39)
QQSYSTPPWT

SEQ ID NO: 4402 - protein, 18 aa, Homo sapiens
  Heavy chain CDR3 for antibody 2201 (IGHV3-13)
ARGNGYYDSSGYYYYFDY

SEQ ID NO: 4403 - protein, 9 aa, Homo sapiens
  Light chain CDR3 for antibody 2202 (IGKV1-9)
QQLDAYPFT

SEQ ID NO: 4404 - protein, 18 aa, Homo sapiens
  Heavy chain CDR3 for antibody 2202 (IGHV1-3)
ARSNIMVGIRGKRSPFEY

SEQ ID NO: 4405 - protein, 9 aa, Homo sapiens
  Light chain CDR3 for antibody 2203 (IGKV1-12)
HQAHSIPLT

SEQ ID NO: 4406 - protein, 12 aa, Homo sapiens
  Heavy chain CDR3 for antibody 2203 (IGHV4-61)
ARDRRGSGWYVD

SEQ ID NO: 4407 - protein, 9 aa, Homo sapiens
  Light chain CDR3 for antibody 2204 (IGKV1-33)
QQYDNLPLT

SEQ ID NO: 4408 - protein, 14 aa, Homo sapiens
  Heavy chain CDR3 for antibody 2204 (IGHV5-a)
ARRTTEYSGSYFYF

SEQ ID NO: 4409 - protein, 9 aa, Homo sapiens
  Light chain CDR3 for antibody 2205 (IGKV1-27)
QKYNSAPRT

SEQ ID NO: 4410 - protein, 9 aa, Homo sapiens
  Heavy chain CDR3 for antibody 2205 (IGHV1-69)
ARDGMGADY

SEQ ID NO: 4411 - protein, 9 aa, Homo sapiens
  Light chain CDR3 for antibody 2206 (IGKV1-5)
QQYNSYSDT

SEQ ID NO: 4412 - protein, 12 aa, Homo sapiens
  Heavy chain CDR3 for antibody 2206 (IGHV4-59)
ARWSPFTAAFDH

SEQ ID NO: 4413 - protein, 9 aa, Homo sapiens
  Light chain CDR3 for antibody 2207 (IGKV3-20)
QQYGSSPWT

SEQ ID NO: 4414 - protein, 11 aa, Homo sapiens
  Heavy chain CDR3 for antibody 2207 (IGHV3-53)
ARDRPGGLHDY

SEQ ID NO: 4415 - protein, 9 aa, Homo sapiens
  Light chain CDR3 for antibody 2208 (IGKV1-12)
QQADSFPIT

SEQ ID NO: 4416 - protein, 16 aa, Homo sapiens
  Heavy chain CDR3 for antibody 2208 (IGHV6-1)
AREGVHGYSGHRPIDN

SEQ ID NO: 4417 - protein, 8 aa, Homo sapiens
  Light chain CDR3 for antibody 2209 (IGKV1-39)
QQSYRTWT

SEQ ID NO: 4418 - protein, 14 aa, Homo sapiens
  Heavy chain CDR3 for antibody 2209 (IGHV4-b)
ASGVAAAGTRWFDP

SEQ ID NO: 4419 - protein, 8 aa, Homo sapiens
  Light chain CDR3 for antibody 2210 (IGKV3-20)
QQYGSSRT

SEQ ID NO: 4420 - protein, 11 aa, Homo sapiens
  Heavy chain CDR3 for antibody 2210 (IGHV3-66)
ARDYGDFYSDY

SEQ ID NO: 4421 - protein, 9 aa, Homo sapiens
  Light chain CDR3 for antibody 2211 (IGKV1-33)
QQYGDLPYS

SEQ ID NO: 4422 - protein, 16 aa, Homo sapiens
  Heavy chain CDR3 for antibody 2211 (IGHV1-58)
AAPYCSSTSCHDAFDI

SEQ ID NO: 4423 - protein, 9 aa, Homo sapiens
  Light chain CDR3 for antibody 2212 (IGKV1-39)
QQSYSTAWT

SEQ ID NO: 4424 - protein, 23 aa, Homo sapiens
  Heavy chain CDR3 for antibody 2212 (IGHV2-26)
ARILRRYFDWLLYSDRGYYYMDV

SEQ ID NO: 4425 - protein, 9 aa, Homo sapiens
  Light chain CDR3 for antibody 2213 (IGKV3-20)
QQYGSSPYT

SEQ ID NO: 4426 - protein, 12 aa, Homo sapiens
  Heavy chain CDR3 for antibody 2213 (IGHV4-b)
ARTHSRGSSIDY

SEQ ID NO: 4427 - protein, 9 aa, Homo sapiens
  Light chain CDR3 for antibody 2214 (IGKV1-33)
QQYGDLPYS

SEQ ID NO: 4428 - protein, 11 aa, Homo sapiens
  Heavy chain CDR3 for antibody 2214 (IGHV3-66)
ARDYGDFYSDY

SEQ ID NO: 4429 - protein, 10 aa, Homo sapiens
  Light chain CDR3 for antibody 2215 (IGKV1-39)
QQSFTTVPFT

SEQ ID NO: 4430 - protein, 23 aa, Homo sapiens
  Heavy chain CDR3 for antibody 2215 (IGHV4-4)
VKVGPIVVVPDDEIFGDADAFEV

SEQ ID NO: 4431 - protein, 9 aa, Homo sapiens
  Light chain CDR3 for antibody 2216 (IGKV1-39)
QQSHRTPWT

SEQ ID NO: 4432 - protein, 11 aa, Homo sapiens
  Heavy chain CDR3 for antibody 2216 (IGHV1-8)
ARVIKGGHSDC

SEQ ID NO: 4433 - protein, 9 aa, Homo sapiens
  Light chain CDR3 for antibody 2217 (IGKV1-9)
QQLNSYPRT

SEQ ID NO: 4434 - protein, 12 aa, Homo sapiens
  Heavy chain CDR3 for antibody 2217 (IGHV4-59)
ARWSPFTAAFDH

SEQ ID NO: 4435 - protein, 9 aa, Homo sapiens
  Light chain CDR3 for antibody 2218 (IGKV1-33)
QQYDNLPFT

SEQ ID NO: 4436 - protein, 21 aa, Homo sapiens
  Heavy chain CDR3 for antibody 2218 (IGHV4-61)
ARERLVDSQQLAPDYYYGMDV

SEQ ID NO: 4437 - protein, 9 aa, Homo sapiens
  Light chain CDR3 for antibody 2219 (IGKV1-33)
QQYGDLPYS

SEQ ID NO: 4438 - protein, 12 aa, Homo sapiens
  Heavy chain CDR3 for antibody 2219 (IGHV1-69)
ATYSTSWHVTDY

SEQ ID NO: 4439 - protein, 9 aa, Homo sapiens
  Light chain CDR3 for antibody 2220 (IGKV3-20)
QQYGSSPWT

SEQ ID NO: 4440 - protein, 18 aa, Homo sapiens
  Heavy chain CDR3 for antibody 2220 (IGHV4-b)
ARGVTTAVFYYFYYYMDV

SEQ ID NO: 4441 - protein, 9 aa, Homo sapiens
  Light chain CDR3 for antibody 2221 (IGKV1-33)
QQYDNLPLT

SEQ ID NO: 4442 - protein, 9 aa, Homo sapiens
  Heavy chain CDR3 for antibody 2221 (IGHV1-69)
ARDGMGADY

SEQ ID NO: 4443 - protein, 9 aa, Homo sapiens
  Light chain CDR3 for antibody 2222 (IGKV4-1)
QQYYSTPPT

SEQ ID NO: 4444 - protein, 16 aa, Homo sapiens
  Heavy chain CDR3 for antibody 2222 (IGHV1-58)
AAPYCSSTSCHDAFDI

SEQ ID NO: 4445 - protein, 9 aa, Homo sapiens
  Light chain CDR3 for antibody 2223 (IGKV3-20)
QQYGSSPFT

SEQ ID NO: 4446 - protein, 11 aa, Homo sapiens
  Heavy chain CDR3 for antibody 2223 (IGHV3-48)
AREGGEDAFDI

SEQ ID NO: 4447 - protein, 7 aa, Homo sapiens
  Light chain CDR3 for antibody 2224 (IGKV1-39)
QESHDWT

SEQ ID NO: 4448 - protein, 17 aa, Homo sapiens
  Heavy chain CDR3 for antibody 2224 (IGHV4-59)
ARVGVLPGNHYYYYMDV

SEQ ID NO: 4449 - protein, 10 aa, Homo sapiens
  Light chain CDR3 for antibody 2225 (IGKV3-11)
QQRGNWPPYS

SEQ ID NO: 4450 - protein, 12 aa, Homo sapiens
  Heavy chain CDR3 for antibody 2225 (IGHV3-11)
AKSTIFGTEFDL

SEQ ID NO: 4451 - protein, 9 aa, Homo sapiens
  Light chain CDR3 for antibody 2226 (IGKV3-20)
QQYGSSPRT

SEQ ID NO: 4452 - protein, 13 aa, Homo sapiens
  Heavy chain CDR3 for antibody 2226 (IGHV3-20)
ARDVGYYNYYMDV

SEQ ID NO: 4453 - protein, 9 aa, Homo sapiens
  Light chain CDR3 for antibody 2227 (IGKV1-33)
QQHDDLPYT

SEQ ID NO: 4454 - protein, 13 aa, Homo sapiens
  Heavy chain CDR3 for antibody 2227 (IGHV4-31)
ARECTSTICTLDT

SEQ ID NO: 4455 - protein, 10 aa, Homo sapiens
  Light chain CDR3 for antibody 2228 (IGKV3-20)
QQYGSSPLWT

SEQ ID NO: 4456 - protein, 16 aa, Homo sapiens
  Heavy chain CDR3 for antibody 2228 (IGHV1-58)
AAPYCSSTSCHDAFDI

SEQ ID NO: 4457 - protein, 9 aa, Homo sapiens
  Light chain CDR3 for antibody 2229 (IGKV2D-28)
MQALQTPLT

SEQ ID NO: 4458 - protein, 14 aa, Homo sapiens
  Heavy chain CDR3 for antibody 2229 (IGHV2-5)
AHRRAVLGAGYFDY

SEQ ID NO: 4459 - protein, 10 aa, Homo sapiens
  Light chain CDR3 for antibody 2230 (IGKV3-11)
QQRSNWPSLT

SEQ ID NO: 4460 - protein, 15 aa, Homo sapiens
  Heavy chain CDR3 for antibody 2230 (IGHV1-69)
ARRVAVFGVGGSGDV

SEQ ID NO: 4461 - protein, 9 aa, Homo sapiens
  Light chain CDR3 for antibody 2231 (IGKV1-12)
HQAHSIPLT

SEQ ID NO: 4462 - protein, 11 aa, Homo sapiens
  Heavy chain CDR3 for antibody 2231 (IGHV4-39)
ARRAYGIGLDH

SEQ ID NO: 4463 - protein, 9 aa, Homo sapiens
  Light chain CDR3 for antibody 2232 (IGKV3D-20)
QQYAYSPTT

SEQ ID NO: 4464 - protein, 12 aa, Homo sapiens
  Heavy chain CDR3 for antibody 2232 (IGHV4-39)
ARATISYGSGDY

SEQ ID NO: 4465 - protein, 9 aa, Homo sapiens
  Light chain CDR3 for antibody 2233 (IGKV1-33)
QQYENLPRT

SEQ ID NO: 4466 - protein, 13 aa, Homo sapiens
  Heavy chain CDR3 for antibody 2233 (IGHV1-2)
ARAITADSRDFDY

SEQ ID NO: 4467 - protein, 9 aa, Homo sapiens
  Light chain CDR3 for antibody 2234 (IGKV1-39)
QQSYSTPYT

SEQ ID NO: 4468 - protein, 12 aa, Homo sapiens
  Heavy chain CDR3 for antibody 2234 (IGHV1-18)
ARDGGPLETFDY

SEQ ID NO: 4469 - protein, 9 aa, Homo sapiens
  Light chain CDR3 for antibody 2235 (IGKV1-27)
QKYNSAPQT

SEQ ID NO: 4470 - protein, 16 aa, Homo sapiens
  Heavy chain CDR3 for antibody 2235 (IGHV4-34)
VRDRPFQLSKYKTVGI

SEQ ID NO: 4471 - protein, 9 aa, Homo sapiens
  Light chain CDR3 for antibody 2236 (IGKV1-39)
QQTYNTRTT

SEQ ID NO: 4472 - protein, 22 aa, Homo sapiens
  Heavy chain CDR3 for antibody 2236 (IGHV4-31)
ARDPPRRITIFGVVMIEGYFDL

SEQ ID NO: 4473 - protein, 9 aa, Homo sapiens
  Light chain CDR3 for antibody 2237 (IGKV1-6)
LQDHDYRQT

SEQ ID NO: 4474 - protein, 16 aa, Homo sapiens
  Heavy chain CDR3 for antibody 2237 (IGHV5-51)
ARRWCSSASCQGVFDY

SEQ ID NO: 4475 - protein, 9 aa, Homo sapiens
  Light chain CDR3 for antibody 2238 (IGKV1-27)
QKYNSAPFT

SEQ ID NO: 4476 - protein, 13 aa, Homo sapiens
  Heavy chain CDR3 for antibody 2238 (IGHV1-69)
ASQTDVVRPGFNI

SEQ ID NO: 4477 - protein, 9 aa, Homo sapiens
  Light chain CDR3 for antibody 2239 (IGKV1D-12)
QQTNSFPLT

SEQ ID NO: 4478 - protein, 10 aa, Homo sapiens
  Heavy chain CDR3 for antibody 2239 (IGHV4-31)
ARVDDYYMDV

SEQ ID NO: 4479 - protein, 9 aa, Homo sapiens
  Light chain CDR3 for antibody 2240 (IGKV1-39)
QQSYSTPLT

SEQ ID NO: 4480 - protein, 11 aa, Homo sapiens
  Heavy chain CDR3 for antibody 2240 (IGHV3-53)
ARDRPGGLHDY

SEQ ID NO: 4481 - protein, 9 aa, Homo sapiens
  Light chain CDR3 for antibody 2241 (IGKV4-1)
QQYYSTPPT

SEQ ID NO: 4482 - protein, 12 aa, Homo sapiens
  Heavy chain CDR3 for antibody 2241 (IGHV1-69)
ATYSTSWHVTDY

SEQ ID NO: 4483 - protein, 10 aa, Homo sapiens
  Light chain CDR3 for antibody 2242 (IGKV1-33)
QQYDNLQGVT

SEQ ID NO: 4484 - protein, 10 aa, Homo sapiens
  Heavy chain CDR3 for antibody 2242 (IGHV1-8)
ARGYRNSYGY

SEQ ID NO: 4485 - protein, 9 aa, Homo sapiens
  Light chain CDR3 for antibody 2243 (IGKV1-33)
QQYDQRPPT

SEQ ID NO: 4486 - protein, 16 aa, Homo sapiens
  Heavy chain CDR3 for antibody 2243 (IGHV1-58)
AAPYCSSTSCHDAFDI

SEQ ID NO: 4487 - protein, 9 aa, Homo sapiens
  Light chain CDR3 for antibody 2244 (IGKV1-5)
QQYNSYPLT

SEQ ID NO: 4488 - protein, 12 aa, Homo sapiens
  Heavy chain CDR3 for antibody 2244 (IGHV4-61)
ARDRRGSGWYVD

SEQ ID NO: 4489 - protein, 9 aa, Homo sapiens
  Light chain CDR3 for antibody 2245 (IGKV3-15)
QQYYDWPET

SEQ ID NO: 4490 - protein, 14 aa, Homo sapiens
  Heavy chain CDR3 for antibody 2245 (IGHV3-11)
AREHSHYDVGAFDI

SEQ ID NO: 4491 - protein, 9 aa, Homo sapiens
  Light chain CDR3 for antibody 2246 (IGKV1-39)
QQSDSAPWT

SEQ ID NO: 4492 - protein, 11 aa, Homo sapiens
  Heavy chain CDR3 for antibody 2246 (IGHV3-11)
ARPGTSWAFDS

SEQ ID NO: 4493 - protein, 10 aa, Homo sapiens
  Light chain CDR3 for antibody 2247 (IGKV1-39)
QQSYSTPSLT

SEQ ID NO: 4494 - protein, 14 aa, Homo sapiens
  Heavy chain CDR3 for antibody 2247 (IGHV1-18)
ARDQGVLLSDYFDY

SEQ ID NO: 4495 - protein, 9 aa, Homo sapiens
  Light chain CDR3 for antibody 2248 (IGKV1-5)
QQYNGYSRA

SEQ ID NO: 4496 - protein, 10 aa, Homo sapiens
  Heavy chain CDR3 for antibody 2248 (IGHV3-48)
AGWYYGRENY

SEQ ID NO: 4497 - protein, 9 aa, Homo sapiens
  Light chain CDR3 for antibody 2249 (IGKV1-39)
QQSYSTPRT

SEQ ID NO: 4498 - protein, 19 aa, Homo sapiens
  Heavy chain CDR3 for antibody 2249 (IGHV4-b)
ARSGRYYDSSASRPHYFDY

SEQ ID NO: 4499 - protein, 9 aa, Homo sapiens
  Light chain CDR3 for antibody 2250 (IGKV1-8)
QQYYSYPPT

SEQ ID NO: 4500 - protein, 11 aa, Homo sapiens
  Heavy chain CDR3 for antibody 2250 (IGHV4-34)
ATGTSYYYMDV

SEQ ID NO: 4501 - protein, 9 aa, Homo sapiens
  Light chain CDR3 for antibody 2251 (IGKV1-39)
QQSYYDHWT

SEQ ID NO: 4502 - protein, 12 aa, Homo sapiens
  Heavy chain CDR3 for antibody 2251 (IGHV4-34)
ARANLTYGSGNF

SEQ ID NO: 4503 - protein, 10 aa, Homo sapiens
  Light chain CDR3 for antibody 2252 (IGKV5-2)
LQHDNFPPRT

SEQ ID NO: 4504 - protein, 11 aa, Homo sapiens
  Heavy chain CDR3 for antibody 2252 (IGHV4-34)
ATGTSYYYMDV

SEQ ID NO: 4505 - protein, 9 aa, Homo sapiens
  Light chain CDR3 for antibody 2253 (IGKV1-39)
QQSDSAPWT

SEQ ID NO: 4506 - protein, 23 aa, Homo sapiens
  Heavy chain CDR3 for antibody 2253 (IGHV4-4)
VKVGPIVVVPDDEIFGDADAFEV

SEQ ID NO: 4507 - protein, 10 aa, Homo sapiens
  Light chain CDR3 for antibody 2254 (IGKV3-20)
QQYGSSPPYS

SEQ ID NO: 4508 - protein, 11 aa, Homo sapiens
  Heavy chain CDR3 for antibody 2254 (IGHV1-8)
ARVIKGGHSDC

SEQ ID NO: 4509 - protein, 9 aa, Homo sapiens
  Light chain CDR3 for antibody 2255 (IGKV3-15)
QQYNKWPPT

SEQ ID NO: 4510 - protein, 12 aa, Homo sapiens
  Heavy chain CDR3 for antibody 2255 (IGHV2-5)
VVVGNFYRPFDY

SEQ ID NO: 4511 - protein, 8 aa, Homo sapiens
  Light chain CDR3 for antibody 2256 (IGKV3-20)
QQYGSSLT

SEQ ID NO: 4512 - protein, 12 aa, Homo sapiens
  Heavy chain CDR3 for antibody 2256 (IGHV3-66)
ARDLGMGSYFDY

SEQ ID NO: 4513 - protein, 9 aa, Homo sapiens
  Light chain CDR3 for antibody 2257 (IGKV3-20)
QQYGSSPWT

SEQ ID NO: 4514 - protein, 11 aa, Homo sapiens
  Heavy chain CDR3 for antibody 2257 (IGHV3-66)
ARDYGDFYSDY

SEQ ID NO: 4515 - protein, 9 aa, Homo sapiens
  Light chain CDR3 for antibody 2258 (IGKV1-9)
QHLSGYPRT

SEQ ID NO: 4516 - protein, 17 aa, Homo sapiens
  Heavy chain CDR3 for antibody 2258 (IGHV1-69)
VSVMGGFDFGEPRPLEY

SEQ ID NO: 4517 - protein, 9 aa, Homo sapiens
  Light chain CDR3 for antibody 2259 (IGKV1-33)
QQYGDLPYS

SEQ ID NO: 4518 - protein, 14 aa, Homo sapiens
  Heavy chain CDR3 for antibody 2259 (IGHV3-h)
ARARTTLQLELFDY

SEQ ID NO: 4519 - protein, 9 aa, Homo sapiens
  Light chain CDR3 for antibody 2260 (IGKV1-39)
QQSYSTLLT

SEQ ID NO: 4520 - protein, 16 aa, Homo sapiens
  Heavy chain CDR3 for antibody 2260 (IGHV4-4)
ARAPSVPAAIFDAFDI

SEQ ID NO: 4521 - protein, 9 aa, Homo sapiens
  Light chain CDR3 for antibody 2261 (IGKV1-27)
QKYNSAPYT

SEQ ID NO: 4522 - protein, 19 aa, Homo sapiens
  Heavy chain CDR3 for antibody 2261 (IGHV5-a)
ARRFRECRGNMCYPYWFDH

SEQ ID NO: 4523 - protein, 9 aa, Homo sapiens
  Light chain CDR3 for antibody 2262 (IGKV3-20)
QQYGSSPWT

SEQ ID NO: 4524 - protein, 16 aa, Homo sapiens
  Heavy chain CDR3 for antibody 2262 (IGHV1-58)
AAPYCSSASCHDAFDV

SEQ ID NO: 4525 - protein, 7 aa, Homo sapiens
  Light chain CDR3 for antibody 2263 (IGKV3-11)
QQRSNWT

SEQ ID NO: 4526 - protein, 17 aa, Homo sapiens
  Heavy chain CDR3 for antibody 2263 (IGHV2-70)
ARIRYDILTGYSSYFDY

SEQ ID NO: 4527 - protein, 10 aa, Homo sapiens
  Light chain CDR3 for antibody 2264 (IGKV1D-12)
QQSYSTPSLT

SEQ ID NO: 4528 - protein, 22 aa, Homo sapiens
  Heavy chain CDR3 for antibody 2264 (IGHV1-69)
ARDALLREYQLLSNAGYYYMDV

SEQ ID NO: 4529 - protein, 9 aa, Homo sapiens
  Light chain CDR3 for antibody 2265 (IGKV1-27)
QKYNSAPQT

SEQ ID NO: 4530 - protein, 14 aa, Homo sapiens
  Heavy chain CDR3 for antibody 2265 (IGHV3-48)
ARDRRDGGYPNCDR

SEQ ID NO: 4531 - protein, 8 aa, Homo sapiens
  Light chain CDR3 for antibody 2266 (IGKV3-20)
QQYGSSRT

SEQ ID NO: 4532 - protein, 12 aa, Homo sapiens
  Heavy chain CDR3 for antibody 2266 (IGHV1-69)
AAYSASWDVTDY

SEQ ID NO: 4533 - protein, 9 aa, Homo sapiens
  Light chain CDR3 for antibody 2267 (IGKV3-20)
QQYGGSSGT

SEQ ID NO: 4534 - protein, 14 aa, Homo sapiens
  Heavy chain CDR3 for antibody 2267 (IGHV1-18)
ARDDFGVLLSYMDV

SEQ ID NO: 4535 - protein, 9 aa, Homo sapiens
  Light chain CDR3 for antibody 2268 (IGKV1-5)
QQHASNPLT

SEQ ID NO: 4536 - protein, 12 aa, Homo sapiens
  Heavy chain CDR3 for antibody 2268 (IGHV5-51)
ARRFSSSELFHF

SEQ ID NO: 4537 - protein, 9 aa, Homo sapiens
  Light chain CDR3 for antibody 2269 (IGKV1-33)
QQYDNLPLT

SEQ ID NO: 4538 - protein, 22 aa, Homo sapiens
  Heavy chain CDR3 for antibody 2269 (IGHV1-8)
ARGQESGAIFGVVIIRARGFDY

SEQ ID NO: 4539 - protein, 10 aa, Homo sapiens
  Light chain CDR3 for antibody 2270 (IGKV2-30)
IQSTHCPSCT

SEQ ID NO: 4540 - protein, 10 aa, Homo sapiens
  Heavy chain CDR3 for antibody 2270 (IGHV5-51)
ARHGPLPFDY

SEQ ID NO: 4541 - protein, 9 aa, Homo sapiens
  Light chain CDR3 for antibody 2271 (IGKV1-33)
QQYDNLPLT

SEQ ID NO: 4542 - protein, 12 aa, Homo sapiens
  Heavy chain CDR3 for antibody 2271 (IGHV1-69)
ATYSTSWHVTDY

SEQ ID NO: 4543 - protein, 9 aa, Homo sapiens
  Light chain CDR3 for antibody 2272 (IGKV3D-20)
QQYGSSPLT

SEQ ID NO: 4544 - protein, 14 aa, Homo sapiens
  Heavy chain CDR3 for antibody 2272 (IGHV1-69)
ARHPYSYDFYYMDV

SEQ ID NO: 4545 - protein, 8 aa, Homo sapiens
  Light chain CDR3 for antibody 2273 (IGKV1-39)
QQSYRTWT

SEQ ID NO: 4546 - protein, 12 aa, Homo sapiens
  Heavy chain CDR3 for antibody 2273 (IGHV4-34)
ARANLTYGSGDF

SEQ ID NO: 4547 - protein, 9 aa, Homo sapiens
  Light chain CDR3 for antibody 2274 (IGKV3-20)
QQYSTSLYS

SEQ ID NO: 4548 - protein, 15 aa, Homo sapiens
  Heavy chain CDR3 for antibody 2274 (IGHV5-a)
ARRLYEWSPHSGFDP

SEQ ID NO: 4549 - protein, 9 aa, Homo sapiens
  Light chain CDR3 for antibody 2275 (IGKV1-5)
QQYNSYPWT

SEQ ID NO: 4550 - protein, 12 aa, Homo sapiens
  Heavy chain CDR3 for antibody 2275 (IGHV3-49)
TRDDFWSGYYSY

SEQ ID NO: 4551 - protein, 9 aa, Homo sapiens
  Light chain CDR3 for antibody 2276 (IGKV1-39)
QQSYSTPRT

SEQ ID NO: 4552 - protein, 15 aa, Homo sapiens
  Heavy chain CDR3 for antibody 2276 (IGHV2-5)
AHGGTMIVAYGAFDI

SEQ ID NO: 4553 - protein, 9 aa, Homo sapiens
  Light chain CDR3 for antibody 2277 (IGKV3-20)
QQYDKPPWT

SEQ ID NO: 4554 - protein, 14 aa, Homo sapiens
  Heavy chain CDR3 for antibody 2277 (IGHV1-69)
GRQELEAMGEFFQH

SEQ ID NO: 4555 - protein, 9 aa, Homo sapiens
  Light chain CDR3 for antibody 2278 (IGKV1-9)
QQLNTYPIT

SEQ ID NO: 4556 - protein, 18 aa, Homo sapiens
  Heavy chain CDR3 for antibody 2278 (IGHV3-33)
LRADCASPGCQGRDIFDI

SEQ ID NO: 4557 - protein, 9 aa, Homo sapiens
  Light chain CDR3 for antibody 2279 (IGKV1-27)
QKYNSAPRT

SEQ ID NO: 4558 - protein, 16 aa, Homo sapiens
  Heavy chain CDR3 for antibody 2279 (IGHV1-58)
AAPYCSSTSCHDAFDI

SEQ ID NO: 4559 - protein, 9 aa, Homo sapiens
  Light chain CDR3 for antibody 2280 (IGKV1-39)
QQVSSTRIT

SEQ ID NO: 4560 - protein, 15 aa, Homo sapiens
  Heavy chain CDR3 for antibody 2280 (IGHV4-39)
ARARPVASRPFFFDF

SEQ ID NO: 4561 - protein, 8 aa, Homo sapiens
  Light chain CDR3 for antibody 2281 (IGKV1-39)
QQSYRTWT

SEQ ID NO: 4562 - protein, 19 aa, Homo sapiens
  Heavy chain CDR3 for antibody 2281 (IGHV4-31)
ARGVPVAIIGVAAYYYMDV

SEQ ID NO: 4563 - protein, 9 aa, Homo sapiens
  Light chain CDR3 for antibody 2282 (IGKV1-39)
QQSYSTPRT

SEQ ID NO: 4564 - protein, 21 aa, Homo sapiens
  Heavy chain CDR3 for antibody 2282 (IGHV4-39)
ARDHPGDSSGYYGPYYYYMDV

SEQ ID NO: 4565 - protein, 9 aa, Homo sapiens
  Light chain CDR3 for antibody 2283 (IGKV1-5)
QQSKTYLND

SEQ ID NO: 4566 - protein, 20 aa, Homo sapiens
  Heavy chain CDR3 for antibody 2283 (IGHV1-69)
ARDGTKGIAAAGTHIPAMDV

SEQ ID NO: 4567 - protein, 9 aa, Homo sapiens
  Light chain CDR3 for antibody 2284 (IGKV3-11)
QQRSNWPWT

SEQ ID NO: 4568 - protein, 9 aa, Homo sapiens
  Heavy chain CDR3 for antibody 2284 (IGHV3-64)
VGPAITAAP

SEQ ID NO: 4569 - protein, 9 aa, Homo sapiens
  Light chain CDR3 for antibody 2285 (IGKV1-5)
QQYNSYWWT

SEQ ID NO: 4570 - protein, 12 aa, Homo sapiens
  Heavy chain CDR3 for antibody 2285 (IGHV4-34)
ARGPTRSRRLTV

SEQ ID NO: 4571 - protein, 8 aa, Homo sapiens
  Light chain CDR3 for antibody 2286 (IGKV3-20)
QQYGSSRT

SEQ ID NO: 4572 - protein, 12 aa, Homo sapiens
  Heavy chain CDR3 for antibody 2286 (IGHV1-69)
ATYSASWRGTDY

SEQ ID NO: 4573 - protein, 9 aa, Homo sapiens
  Light chain CDR3 for antibody 2287 (IGKV1-5)
QQYNSYSWT

SEQ ID NO: 4574 - protein, 9 aa, Homo sapiens
  Heavy chain CDR3 for antibody 2287 (IGHV3-21)
ARGWDYFDY

SEQ ID NO: 4575 - protein, 9 aa, Homo sapiens
  Light chain CDR3 for antibody 2288 (IGKV3-20)
QQYGSSPWT

SEQ ID NO: 4576 - protein, 16 aa, Homo sapiens
  Heavy chain CDR3 for antibody 2288 (IGHV1-58)
AAPYCSSAGGHDAFDI

SEQ ID NO: 4577 - protein, 9 aa, Homo sapiens
  Light chain CDR3 for antibody 2289 (IGKV1-33)
QQYDNLPLT

SEQ ID NO: 4578 - protein, 12 aa, Homo sapiens
  Heavy chain CDR3 for antibody 2289 (IGHV1-8)
ARATRYQLVSDP

SEQ ID NO: 4579 - protein, 8 aa, Homo sapiens
  Light chain CDR3 for antibody 2290 (IGKV3-11)
QQRSNWLT

SEQ ID NO: 4580 - protein, 13 aa, Homo sapiens
  Heavy chain CDR3 for antibody 2290 (IGHV1-3)
ARDNGDSGWAFDY

SEQ ID NO: 4581 - protein, 9 aa, Homo sapiens
  Light chain CDR3 for antibody 2291 (IGKV1-39)
QQTYSSSIT

SEQ ID NO: 4582 - protein, 16 aa, Homo sapiens
  Heavy chain CDR3 for antibody 2291 (IGHV4-b)
ARLGQWLVLRNDGLDI

SEQ ID NO: 4583 - protein, 9 aa, Homo sapiens
  Light chain CDR3 for antibody 2292 (IGKV1-39)
QQSYSNPLA

SEQ ID NO: 4584 - protein, 12 aa, Homo sapiens
  Heavy chain CDR3 for antibody 2292 (IGHV1-69)
AAGSGSSWYSDY

SEQ ID NO: 4585 - protein, 9 aa, Homo sapiens
  Light chain CDR3 for antibody 2293 (IGKV1D-12)
QQSYNNPRT

SEQ ID NO: 4586 - protein, 18 aa, Homo sapiens
  Heavy chain CDR3 for antibody 2293 (IGHV3-74)
ARVKTTTGSGWYGDAFDV

SEQ ID NO: 4587 - protein, 9 aa, Homo sapiens
  Light chain CDR3 for antibody 2294 (IGKV1-39)
QQSYSTLLT

SEQ ID NO: 4588 - protein, 21 aa, Homo sapiens
  Heavy chain CDR3 for antibody 2294 (IGHV4-61)
ARERLVDSQQLAPDYYYGMDV

SEQ ID NO: 4589 - protein, 9 aa, Homo sapiens
  Light chain CDR3 for antibody 2295 (IGKV1-9)
QQLNSYPLT

SEQ ID NO: 4590 - protein, 22 aa, Homo sapiens
  Heavy chain CDR3 for antibody 2295 (IGHV4-34)
ARGTVVKYQLLFSSYFYYYMDV

SEQ ID NO: 4591 - protein, 9 aa, Homo sapiens
  Light chain CDR3 for antibody 2296 (IGKV3-20)
QQYGSSPWT

SEQ ID NO: 4592 - protein, 14 aa, Homo sapiens
  Heavy chain CDR3 for antibody 2296 (IGHV3-h)
ARARTTLQLELFDY

SEQ ID NO: 4593 - protein, 10 aa, Homo sapiens
  Light chain CDR3 for antibody 2297 (IGKV3-20)
QQYGTSPPGT

SEQ ID NO: 4594 - protein, 11 aa, Homo sapiens
  Heavy chain CDR3 for antibody 2297 (IGHV5-51)
ARLRYYDYMDV

SEQ ID NO: 4595 - protein, 8 aa, Homo sapiens
  Light chain CDR3 for antibody 2298 (IGKV3-20)
QQYGSSRT

SEQ ID NO: 4596 - protein, 11 aa, Homo sapiens
  Heavy chain CDR3 for antibody 2298 (IGHV3-53)
ARDRPGGLHDY

SEQ ID NO: 4597 - protein, 9 aa, Homo sapiens
  Light chain CDR3 for antibody 2299 (IGKV3-20)
QQYGSSPQT

SEQ ID NO: 4598 - protein, 27 aa, Homo sapiens
  Heavy chain CDR3 for antibody 2299 (IGHV1-18)
ARDSYRVIVVVPAAIDDERYYYYGMDV

SEQ ID NO: 4599 - protein, 9 aa, Homo sapiens
  Light chain CDR3 for antibody 2300 (IGKV1-39)
QQSHSTPYT

SEQ ID NO: 4600 - protein, 14 aa, Homo sapiens
  Heavy chain CDR3 for antibody 2300 (IGHV4-30-2)
ARDGFSGYDNWFDP

SEQ ID NO: 4601 - protein, 9 aa, Homo sapiens
  Light chain CDR3 for antibody 2301 (IGKV1-27)
QKYNSAPYT

SEQ ID NO: 4602 - protein, 16 aa, Homo sapiens
  Heavy chain CDR3 for antibody 2301 (IGHV1-46)
ARGSATIYGVVLPFDF

SEQ ID NO: 4603 - protein, 9 aa, Homo sapiens
  Light chain CDR3 for antibody 2302 (IGKV1-5)
QQYSNDSRT

SEQ ID NO: 4604 - protein, 18 aa, Homo sapiens
  Heavy chain CDR3 for antibody 2302 (IGHV4-59)
ARSPGLIFGVVGRHYFDH

SEQ ID NO: 4605 - protein, 9 aa, Homo sapiens
  Light chain CDR3 for antibody 2303 (IGKV1-39)
QQSYSTLIT

SEQ ID NO: 4606 - protein, 16 aa, Homo sapiens
  Heavy chain CDR3 for antibody 2303 (IGHV3-64)
AKDHCSSATCSYAFDI

SEQ ID NO: 4607 - protein, 9 aa, Homo sapiens
  Light chain CDR3 for antibody 2304 (IGKV1-39)
QQSYSNPLA

SEQ ID NO: 4608 - protein, 19 aa, Homo sapiens
  Heavy chain CDR3 for antibody 2304 (IGHV1-18)
AGGTYDWNNGVPLPDAFDM

SEQ ID NO: 4609 - protein, 9 aa, Homo sapiens
  Light chain CDR3 for antibody 2305 (IGKV1-39)
QQSYNMPPT

SEQ ID NO: 4610 - protein, 11 aa, Homo sapiens
  Heavy chain CDR3 for antibody 2305 (IGHV3-66)
ARDYGDFYSDY

SEQ ID NO: 4611 - protein, 9 aa, Homo sapiens
  Light chain CDR3 for antibody 2306 (IGKV1-33)
QQYDNLPFT

SEQ ID NO: 4612 - protein, 18 aa, Homo sapiens
  Heavy chain CDR3 for antibody 2306 (IGHV4-30-2)
ARSFADVLTDYPLSPLGV

SEQ ID NO: 4613 - protein, 8 aa, Homo sapiens
  Light chain CDR3 for antibody 2307 (IGKV2D-28)
MQALQTIT

SEQ ID NO: 4614 - protein, 12 aa, Homo sapiens
  Heavy chain CDR3 for antibody 2307 (IGHV2-5)
AHRISWGLAFDI

SEQ ID NO: 4615 - protein, 9 aa, Homo sapiens
  Light chain CDR3 for antibody 2308 (IGKV3-20)
QQYGSSPWT

SEQ ID NO: 4616 - protein, 16 aa, Homo sapiens
  Heavy chain CDR3 for antibody 2308 (IGHV1-58)
AAPYCSSASWHDAFDI

SEQ ID NO: 4617 - protein, 9 aa, Homo sapiens
  Light chain CDR3 for antibody 2309 (IGKV2-30)
MQGSHWPPT

SEQ ID NO: 4618 - protein, 17 aa, Homo sapiens
  Heavy chain CDR3 for antibody 2309 (IGHV4-b)
ARHPVQFLDWLFWYFDL

SEQ ID NO: 4619 - protein, 9 aa, Homo sapiens
  Light chain CDR3 for antibody 2310 (IGKV1-33)
QQYDNLPLT

SEQ ID NO: 4620 - protein, 16 aa, Homo sapiens
  Heavy chain CDR3 for antibody 2310 (IGHV1-58)
AAPYCSSTSCHDAFDI

SEQ ID NO: 4621 - protein, 9 aa, Homo sapiens
  Light chain CDR3 for antibody 2311 (IGKV3-20)
QQYGSSPWT

SEQ ID NO: 4622 - protein, 16 aa, Homo sapiens
  Heavy chain CDR3 for antibody 2311 (IGHV1-58)
AAAYCSSGSCDDAFDV

SEQ ID NO: 4623 - protein, 9 aa, Homo sapiens
  Light chain CDR3 for antibody 2312 (IGKV1-5)
QQYDTYPYS

SEQ ID NO: 4624 - protein, 9 aa, Homo sapiens
  Heavy chain CDR3 for antibody 2312 (IGHV3-21)
ARGWDYFDY

SEQ ID NO: 4625 - protein, 9 aa, Homo sapiens
  Light chain CDR3 for antibody 2313 (IGKV3-20)
QQYGSSPWT

SEQ ID NO: 4626 - protein, 16 aa, Homo sapiens
  Heavy chain CDR3 for antibody 2313 (IGHV6-1)
AREGVHGYSGHRPIDN

SEQ ID NO: 4627 - protein, 9 aa, Homo sapiens
  Light chain CDR3 for antibody 2314 (IGKV1-39)
QQSYSTLLT

SEQ ID NO: 4628 - protein, 20 aa, Homo sapiens
  Heavy chain CDR3 for antibody 2314 (IGHV3-53)
ARGAYGDYVRWSYYYYYMDV

SEQ ID NO: 4629 - protein, 9 aa, Homo sapiens
  Light chain CDR3 for antibody 2315 (IGKV1-9)
QQLDAYPFT

SEQ ID NO: 4630 - protein, 13 aa, Homo sapiens
  Heavy chain CDR3 for antibody 2315 (IGHV1-8)
ARASQIVPTVNNY

SEQ ID NO: 4631 - protein, 9 aa, Homo sapiens
  Light chain CDR3 for antibody 2316 (IGKV3-11)
QQRSNWPFP

SEQ ID NO: 4632 - protein, 10 aa, Homo sapiens
  Heavy chain CDR3 for antibody 2316 (IGHV3-53)
ARDIGEGVGP

SEQ ID NO: 4633 - protein, 9 aa, Homo sapiens
  Light chain CDR3 for antibody 2317 (IGKV1-33)
QQYDNLPFT

SEQ ID NO: 4634 - protein, 15 aa, Homo sapiens
  Heavy chain CDR3 for antibody 2317 (IGHV3-30)
ATDPPSSWSGYPLDY

SEQ ID NO: 4635 - protein, 9 aa, Homo sapiens
  Light chain CDR3 for antibody 2318 (IGKV4-1)
QQYYSTPRT

SEQ ID NO: 4636 - protein, 12 aa, Homo sapiens
  Heavy chain CDR3 for antibody 2318 (IGHV4-61)
ARDNENEFMIDS

SEQ ID NO: 4637 - protein, 8 aa, Homo sapiens
  Light chain CDR3 for antibody 2319 (IGKV3-20)
QQYGSSRT

SEQ ID NO: 4638 - protein, 12 aa, Homo sapiens
  Heavy chain CDR3 for antibody 2319 (IGHV1-69)
ATYSAIWRVADY

SEQ ID NO: 4639 - protein, 9 aa, Homo sapiens
  Light chain CDR3 for antibody 2320 (IGKV1-27)
QKYNSAPRT

SEQ ID NO: 4640 - protein, 12 aa, Homo sapiens
  Heavy chain CDR3 for antibody 2320 (IGHV1-69)
ASVDSSKDAFDI

SEQ ID NO: 4641 - protein, 9 aa, Homo sapiens
  Light chain CDR3 for antibody 2321 (IGKV3-20)
QQYGSSPWT

SEQ ID NO: 4642 - protein, 16 aa, Homo sapiens
  Heavy chain CDR3 for antibody 2321 (IGHV1-58)
AAAYCSSTSCDDAFDI

SEQ ID NO: 4643 - protein, 9 aa, Homo sapiens
  Light chain CDR3 for antibody 2322 (IGKV1-39)
LQAYTFPIT

SEQ ID NO: 4644 - protein, 15 aa, Homo sapiens
  Heavy chain CDR3 for antibody 2322 (IGHV3-21)
VSDVRRGDSYGWFDP

SEQ ID NO: 4645 - protein, 8 aa, Homo sapiens
  Light chain CDR3 for antibody 2323 (IGKV3-20)
QQYGSSRT

SEQ ID NO: 4646 - protein, 12 aa, Homo sapiens
  Heavy chain CDR3 for antibody 2323 (IGHV1-69)
APYSPSWHVNDY

SEQ ID NO: 4647 - protein, 9 aa, Homo sapiens
  Light chain CDR3 for antibody 2324 (IGKV1-39)
QQSHRTPWT

SEQ ID NO: 4648 - protein, 9 aa, Homo sapiens
  Heavy chain CDR3 for antibody 2324 (IGHV1-69)
ARDGMGADY

SEQ ID NO: 4649 - protein, 9 aa, Homo sapiens
  Light chain CDR3 for antibody 2325 (IGKV1-33)
QQYDQRPPT

SEQ ID NO: 4650 - protein, 14 aa, Homo sapiens
  Heavy chain CDR3 for antibody 2325 (IGHV1-69)
ARDRDDFWFGGMDV

SEQ ID NO: 4651 - protein, 9 aa, Homo sapiens
  Light chain CDR3 for antibody 2326 (IGKV1-39)
QQSHRTPWT

SEQ ID NO: 4652 - protein, 19 aa, Homo sapiens
  Heavy chain CDR3 for antibody 2326 (IGHV1-69)
ARAPTQIHLWEPVRGGFEY

SEQ ID NO: 4653 - protein, 9 aa, Homo sapiens
  Light chain CDR3 for antibody 2327 (IGKV1-39)
QQSYSTPPT

SEQ ID NO: 4654 - protein, 11 aa, Homo sapiens
  Heavy chain CDR3 for antibody 2327 (IGHV3-11)
ARPGTSWAFDS

SEQ ID NO: 4655 - protein, 9 aa, Homo sapiens
  Light chain CDR3 for antibody 2328 (IGKV4-1)
QQYYSTPWT

SEQ ID NO: 4656 - protein, 18 aa, Homo sapiens
  Heavy chain CDR3 for antibody 2328 (IGHV1-3)
ARSNIMVGIRGKRSPFEY

SEQ ID NO: 4657 - protein, 9 aa, Homo sapiens
  Light chain CDR3 for antibody 2329 (IGKV3-20)
QQYGSSPWT

SEQ ID NO: 4658 - protein, 16 aa, Homo sapiens
  Heavy chain CDR3 for antibody 2329 (IGHV3-30)
AKNGYSYGYGFYYFDY

SEQ ID NO: 4659 - protein, 9 aa, Homo sapiens
  Light chain CDR3 for antibody 2330 (IGKV3-20)
QQYGSSPWT

SEQ ID NO: 4660 - protein, 16 aa, Homo sapiens
  Heavy chain CDR3 for antibody 2330 (IGHV1-58)
AAQYCSSPSCHDAFDI

SEQ ID NO: 4661 - protein, 9 aa, Homo sapiens
  Light chain CDR3 for antibody 2331 (IGKV3-20)
QQYGSSPWT

SEQ ID NO: 4662 - protein, 16 aa, Homo sapiens
  Heavy chain CDR3 for antibody 2331 (IGHV1-58)
AEPYCSSPSCHDAFDI

SEQ ID NO: 4663 - protein, 10 aa, Homo sapiens
  Light chain CDR3 for antibody 2332 (IGKV1-9)
QQLNSYPPIT

SEQ ID NO: 4664 - protein, 16 aa, Homo sapiens
  Heavy chain CDR3 for antibody 2332 (IGHV3-33)
ARNLGSGSYVRGPFDY

SEQ ID NO: 4665 - protein, 9 aa, Homo sapiens
  Light chain CDR3 for antibody 2333 (IGKV1-5)
QQYNSYSDT

SEQ ID NO: 4666 - protein, 12 aa, Homo sapiens
  Heavy chain CDR3 for antibody 2333 (IGHV1-69)
ATYSTSWHVTDY

SEQ ID NO: 4667 - protein, 10 aa, Homo sapiens
  Light chain CDR3 for antibody 2334 (IGKV1-5)
QQYYDYSGST

SEQ ID NO: 4668 - protein, 23 aa, Homo sapiens
  Heavy chain CDR3 for antibody 2334 (IGHV7-4-1)
ARNRGRDVWSDHYGEQHSDFFDL

SEQ ID NO: 4669 - protein, 9 aa, Homo sapiens
  Light chain CDR3 for antibody 2335 (IGKV3-20)
QQYGSSPWT

SEQ ID NO: 4670 - protein, 16 aa, Homo sapiens
  Heavy chain CDR3 for antibody 2335 (IGHV1-58)
AAPYCSSTSCHGGFDI

SEQ ID NO: 4671 - protein, 9 aa, Homo sapiens
  Light chain CDR3 for antibody 2336 (IGKV3-20)
QQYGSSPWT

SEQ ID NO: 4672 - protein, 16 aa, Homo sapiens
  Heavy chain CDR3 for antibody 2336 (IGHV1-58)
AAPYCSSASCHYSFDI

SEQ ID NO: 4673 - protein, 9 aa, Homo sapiens
  Light chain CDR3 for antibody 2337 (IGKV1-33)
QQHDDLPYT

SEQ ID NO: 4674 - protein, 20 aa, Homo sapiens
  Heavy chain CDR3 for antibody 2337 (IGHV4-61)
ARVVGGITSVGPVAPNYFDY

SEQ ID NO: 4675 - protein, 8 aa, Homo sapiens
  Light chain CDR3 for antibody 2338 (IGKV3-20)
QQYGSSRT

SEQ ID NO: 4676 - protein, 12 aa, Homo sapiens
  Heavy chain CDR3 for antibody 2338 (IGHV1-18)
ARDGGPLETFDY

SEQ ID NO: 4677 - protein, 7 aa, Homo sapiens
  Light chain CDR3 for antibody 2339 (IGKV3-20)
QQYGSSL

SEQ ID NO: 4678 - protein, 11 aa, Homo sapiens
  Heavy chain CDR3 for antibody 2339 (IGHV3-53)
ARGQWEYYFDY

SEQ ID NO: 4679 - protein, 9 aa, Homo sapiens
  Light chain CDR3 for antibody 2340 (IGKV3-20)
QQYGSSPWT

SEQ ID NO: 4680 - protein, 16 aa, Homo sapiens
  Heavy chain CDR3 for antibody 2340 (IGHV1-58)
AAPYCSSTNYHDSFDI

SEQ ID NO: 4681 - protein, 9 aa, Homo sapiens
  Light chain CDR3 for antibody 2341 (IGKV1-39)
QQSDSAPWT

SEQ ID NO: 4682 - protein, 15 aa, Homo sapiens
  Heavy chain CDR3 for antibody 2341 (IGHV1-18)
ARSHLYYDFWSGYKV

SEQ ID NO: 4683 - protein, 8 aa, Homo sapiens
  Light chain CDR3 for antibody 2342 (IGKV3-20)
QQYGSSRT

SEQ ID NO: 4684 - protein, 12 aa, Homo sapiens
  Heavy chain CDR3 for antibody 2342 (IGHV1-69)
ASYSASWHGTDY

SEQ ID NO: 4685 - protein, 9 aa, Homo sapiens
  Light chain CDR3 for antibody 2343 (IGKV1-33)
QQYDNLPLT

SEQ ID NO: 4686 - protein, 22 aa, Homo sapiens
  Heavy chain CDR3 for antibody 2343 (IGHV1-69)
ARDALLREYQLLSNAGYYYMDV

SEQ ID NO: 4687 - protein, 8 aa, Homo sapiens
  Light chain CDR3 for antibody 2344 (IGKV1-33)
QHYDSLPV

SEQ ID NO: 4688 - protein, 18 aa, Homo sapiens
  Heavy chain CDR3 for antibody 2344 (IGHV1-69)
ARDVRLCNSNRCYGPFDN

SEQ ID NO: 4689 - protein, 9 aa, Homo sapiens
  Light chain CDR3 for antibody 2345 (IGKV1-39)
QQTYNTPYT

SEQ ID NO: 4690 - protein, 18 aa, Homo sapiens
  Heavy chain CDR3 for antibody 2345 (IGHV4-b)
ARGVTTAVFYYFYYYMDV

SEQ ID NO: 4691 - protein, 9 aa, Homo sapiens
  Light chain CDR3 for antibody 2346 (IGKV1-39)
QQSYSTPRT

SEQ ID NO: 4692 - protein, 16 aa, Homo sapiens
  Heavy chain CDR3 for antibody 2346 (IGHV4-34)
ARDGRIHSYGHDYFDY

SEQ ID NO: 4693 - protein, 9 aa, Homo sapiens
  Light chain CDR3 for antibody 2347 (IGKV3-20)
QQYGSSPWT

SEQ ID NO: 4694 - protein, 16 aa, Homo sapiens
  Heavy chain CDR3 for antibody 2347 (IGHV1-58)
AGPYCSSASCHEAFDI

SEQ ID NO: 4695 - protein, 9 aa, Homo sapiens
  Light chain CDR3 for antibody 2348 (IGKV3-20)
QQYDSSPRT

SEQ ID NO: 4696 - protein, 12 aa, Homo sapiens
  Heavy chain CDR3 for antibody 2348 (IGHV4-61)
ARDRRGSGWYVD

SEQ ID NO: 4697 - protein, 8 aa, Homo sapiens
  Light chain CDR3 for antibody 2349 (IGKV1-39)
QQSYSTLT

SEQ ID NO: 4698 - protein, 22 aa, Homo sapiens
  Heavy chain CDR3 for antibody 2349 (IGHV4-34)
ARGAVVEYQLLFSSYFYYYMDV

SEQ ID NO: 4699 - protein, 9 aa, Homo sapiens
  Light chain CDR3 for antibody 2350 (IGKV4-1)
QQYYSTPPT

SEQ ID NO: 4700 - protein, 16 aa, Homo sapiens
  Heavy chain CDR3 for antibody 2350 (IGHV3-30)
AKNGYSYGYGFYYFDY

SEQ ID NO: 4701 - protein, 9 aa, Homo sapiens
  Light chain CDR3 for antibody 2351 (IGKV3-20)
QQYGSSPWT

SEQ ID NO: 4702 - protein, 11 aa, Homo sapiens
  Heavy chain CDR3 for antibody 2351 (IGHV1-58)
SSTSCHDAFDI

SEQ ID NO: 4703 - protein, 9 aa, Homo sapiens
  Light chain CDR3 for antibody 2352 (IGKV3-20)
QQYGSSPWT

SEQ ID NO: 4704 - protein, 11 aa, Homo sapiens
  Heavy chain CDR3 for antibody 2352 (IGHV1-2)
AGALVNPTLDR

SEQ ID NO: 4705 - protein, 9 aa, Homo sapiens
  Light chain CDR3 for antibody 2353 (IGKV3-11)
QQGSSRPLT

SEQ ID NO: 4706 - protein, 12 aa, Homo sapiens
  Heavy chain CDR3 for antibody 2353 (IGHV3-66)
ARDLGMGSYFDY

SEQ ID NO: 4707 - protein, 8 aa, Homo sapiens
  Light chain CDR3 for antibody 2354 (IGKV3-20)
QQYGSSRT

SEQ ID NO: 4708 - protein, 9 aa, Homo sapiens
  Heavy chain CDR3 for antibody 2354 (IGHV3-64)
VGPAITAAP

SEQ ID NO: 4709 - protein, 9 aa, Homo sapiens
  Light chain CDR3 for antibody 2355 (IGKV1-33)
QQYDNLPLT

SEQ ID NO: 4710 - protein, 11 aa, Homo sapiens
  Heavy chain CDR3 for antibody 2355 (IGHV5-a)
AREGETIGYYS

SEQ ID NO: 4711 - protein, 9 aa, Homo sapiens
  Light chain CDR3 for antibody 2356 (IGKV3-20)
HHYGSSPWT

SEQ ID NO: 4712 - protein, 16 aa, Homo sapiens
  Heavy chain CDR3 for antibody 2356 (IGHV1-58)
AAPYCSSTSCHDAFDI

SEQ ID NO: 4713 - protein, 9 aa, Homo sapiens
  Light chain CDR3 for antibody 2357 (IGKV1-39)
QQSYRTPYT

SEQ ID NO: 4714 - protein, 19 aa, Homo sapiens
  Heavy chain CDR3 for antibody 2357 (IGHV1-8)
ATPRGDSSGWYGYYYGMDV

SEQ ID NO: 4715 - protein, 9 aa, Homo sapiens
  Light chain CDR3 for antibody 2358 (IGKV1-33)
QQYDNLPLT

SEQ ID NO: 4716 - protein, 19 aa, Homo sapiens
  Heavy chain CDR3 for antibody 2358 (IGHV5-51)
ARRFRECRGNMCYPYWFDH

SEQ ID NO: 4717 - protein, 9 aa, Homo sapiens
  Light chain CDR3 for antibody 2359 (IGKV1-27)
QKYNSAPRT

SEQ ID NO: 4718 - protein, 12 aa, Homo sapiens
  Heavy chain CDR3 for antibody 2359 (IGHV1-69)
ATYSTSWHVTDY

SEQ ID NO: 4719 - protein, 9 aa, Homo sapiens
  Light chain CDR3 for antibody 2360 (IGKV1-33)
QQYYDLPYS

SEQ ID NO: 4720 - protein, 11 aa, Homo sapiens
  Heavy chain CDR3 for antibody 2360 (IGHV3-53)
ARDRAGGLLDY

SEQ ID NO: 4721 - protein, 9 aa, Homo sapiens
  Light chain CDR3 for antibody 2361 (IGKV3-20)
QQYGSSPWT

SEQ ID NO: 4722 - protein, 16 aa, Homo sapiens
  Heavy chain CDR3 for antibody 2361 (IGHV1-58)
AAAYCSSASCHDAFDI

SEQ ID NO: 4723 - protein, 9 aa, Homo sapiens
  Light chain CDR3 for antibody 2362 (IGKV3-20)
QQYGSSPWT

SEQ ID NO: 4724 - protein, 16 aa, Homo sapiens
  Heavy chain CDR3 for antibody 2362 (IGHV1-58)
AAAYCSSPCCHDAFDI

SEQ ID NO: 4725 - protein, 9 aa, Homo sapiens
  Light chain CDR3 for antibody 2363 (IGKV1-5)
QQYNSYSWT

SEQ ID NO: 4726 - protein, 15 aa, Homo sapiens
  Heavy chain CDR3 for antibody 2363 (IGHV6-1)
ARDDLVGATLGAFDI

SEQ ID NO: 4727 - protein, 9 aa, Homo sapiens
  Light chain CDR3 for antibody 2364 (IGKV1-8)
QQYYVYPRT

SEQ ID NO: 4728 - protein, 16 aa, Homo sapiens
  Heavy chain CDR3 for antibody 2364 (IGHV1-2)
ASGTTIFGVVINWFDP

SEQ ID NO: 4729 - protein, 9 aa, Homo sapiens
  Light chain CDR3 for antibody 2365 (IGKV3D-20)
QQYAYSPTT

SEQ ID NO: 4730 - protein, 11 aa, Homo sapiens
  Heavy chain CDR3 for antibody 2365 (IGHV4-34)
ARVTEAYRDQT

SEQ ID NO: 4731 - protein, 9 aa, Homo sapiens
  Light chain CDR3 for antibody 2366 (IGKV3-20)
QQYGSSPWT

SEQ ID NO: 4732 - protein, 18 aa, Homo sapiens
  Heavy chain CDR3 for antibody 2366 (IGHV1-3)
ARSNIMVGIRGKRSPFEY

SEQ ID NO: 4733 - protein, 9 aa, Homo sapiens
  Light chain CDR3 for antibody 2367 (IGKV1-5)
QQYNTYSWT

SEQ ID NO: 4734 - protein, 14 aa, Homo sapiens
  Heavy chain CDR3 for antibody 2367 (IGHV3-66)
ARDLTAAGHNWFDP

SEQ ID NO: 4735 - protein, 9 aa, Homo sapiens
  Light chain CDR3 for antibody 2368 (IGKV1-33)
QQYGDLPYS

SEQ ID NO: 4736 - protein, 16 aa, Homo sapiens
  Heavy chain CDR3 for antibody 2368 (IGHV3-30)
AKNGYSYGYGFYYFDY

SEQ ID NO: 4737 - protein, 9 aa, Homo sapiens
  Light chain CDR3 for antibody 2369 (IGKV3-20)
QQYGSSPWT

SEQ ID NO: 4738 - protein, 15 aa, Homo sapiens
  Heavy chain CDR3 for antibody 2369 (IGHV1-69)
ARRVAVFGVGGSGDV

SEQ ID NO: 4739 - protein, 9 aa, Homo sapiens
  Light chain CDR3 for antibody 2370 (IGKV1-17)
LQHYNYPWT

SEQ ID NO: 4740 - protein, 11 aa, Homo sapiens
  Heavy chain CDR3 for antibody 2370 (IGHV7-4-1)
TRGGFGTTADY

SEQ ID NO: 4741 - protein, 9 aa, Homo sapiens
  Light chain CDR3 for antibody 2371 (IGKV3-20)
QQYGSSPYT

SEQ ID NO: 4742 - protein, 13 aa, Homo sapiens
  Heavy chain CDR3 for antibody 2371 (IGHV1-69)
AREEGLARDAFDI

SEQ ID NO: 4743 - protein, 9 aa, Homo sapiens
  Light chain CDR3 for antibody 2372 (IGKV3-20)
QQYGSSPWT

SEQ ID NO: 4744 - protein, 14 aa, Homo sapiens
  Heavy chain CDR3 for antibody 2372 (IGHV4-b)
ASGVAAAGTRWFDP

SEQ ID NO: 4745 - protein, 9 aa, Homo sapiens
  Light chain CDR3 for antibody 2373 (IGKV3-20)
QQYGSSMYT

SEQ ID NO: 4746 - protein, 21 aa, Homo sapiens
  Heavy chain CDR3 for antibody 2373 (IGHV4-59)
ARDHPGDSSGYYGPYYYYMDV

SEQ ID NO: 4747 - protein, 9 aa, Homo sapiens
  Light chain CDR3 for antibody 2374 (IGKV1-39)
QQYNSYPPT

SEQ ID NO: 4748 - protein, 17 aa, Homo sapiens
  Heavy chain CDR3 for antibody 2374 (IGHV5-a)
ARRMDSSPGNYYYYMDV

SEQ ID NO: 4749 - protein, 9 aa, Homo sapiens
  Light chain CDR3 for antibody 2375 (IGKV1-39)
QQSHRTPWT

SEQ ID NO: 4750 - protein, 12 aa, Homo sapiens
  Heavy chain CDR3 for antibody 2375 (IGHV1-69)
ATYSTSWHVTDY

SEQ ID NO: 4751 - protein, 8 aa, Homo sapiens
  Light chain CDR3 for antibody 2376 (IGKV3-20)
QQYGSSRT

SEQ ID NO: 4752 - protein, 23 aa, Homo sapiens
  Heavy chain CDR3 for antibody 2376 (IGHV1-8)
ATLEFVVVPAAPGGAHYYYGMDV

SEQ ID NO: 4753 - protein, 9 aa, Homo sapiens
  Light chain CDR3 for antibody 2377 (IGKV3-20)
QQYDSSPRT

SEQ ID NO: 4754 - protein, 13 aa, Homo sapiens
  Heavy chain CDR3 for antibody 2377 (IGHV4-59)
AAYSTGYYNYMDV

SEQ ID NO: 4755 - protein, 9 aa, Homo sapiens
  Light chain CDR3 for antibody 2378 (IGKV6-21)
HQSSRLPQT

SEQ ID NO: 4756 - protein, 17 aa, Homo sapiens
  Heavy chain CDR3 for antibody 2378 (IGHV4-30-2)
ASLDIVLLPASRGTPDY

SEQ ID NO: 4757 - protein, 8 aa, Homo sapiens
  Light chain CDR3 for antibody 2379 (IGKV3-20)
QQYGSSRT

SEQ ID NO: 4758 - protein, 12 aa, Homo sapiens
  Heavy chain CDR3 for antibody 2379 (IGHV1-69)
AAYSTSCHYIDY

SEQ ID NO: 4759 - protein, 9 aa, Homo sapiens
  Light chain CDR3 for antibody 2380 (IGKV6-21)
HQSSSFPIT

SEQ ID NO: 4760 - protein, 21 aa, Homo sapiens
  Heavy chain CDR3 for antibody 2380 (IGHV3-30)
ARDGHYDSSGYHGYYYYYMDV

SEQ ID NO: 4761 - protein, 9 aa, Homo sapiens
  Light chain CDR3 for antibody 2381 (IGKV1-9)
QQLNSYSYT

SEQ ID NO: 4762 - protein, 9 aa, Homo sapiens
  Heavy chain CDR3 for antibody 2381 (IGHV3-53)
ARESYGMDV

SEQ ID NO: 4763 - protein, 9 aa, Homo sapiens
  Light chain CDR3 for antibody 2382 (IGKV1-9)
QQLNSYPQT

SEQ ID NO: 4764 - protein, 11 aa, Homo sapiens
  Heavy chain CDR3 for antibody 2382 (IGHV3-53)
ARDLQVYGMDV

SEQ ID NO: 4765 - protein, 9 aa, Homo sapiens
  Light chain CDR3 for antibody 2383 (IGKV1-39)
QQSYSTPPT

SEQ ID NO: 4766 - protein, 19 aa, Homo sapiens
  Heavy chain CDR3 for antibody 2383 (IGHV1-69)
ARAHRSSTSYRLGINWFDP

SEQ ID NO: 4767 - protein, 9 aa, Homo sapiens
  Light chain CDR3 for antibody 2384 (IGKV1-33)
QQYDNLPLT

SEQ ID NO: 4768 - protein, 13 aa, Homo sapiens
  Heavy chain CDR3 for antibody 2384 (IGHV4-31)
ARDYGGNSAQFGY

SEQ ID NO: 4769 - protein, 9 aa, Homo sapiens
  Light chain CDR3 for antibody 2385 (IGKV1-9)
QQLNSYPPP

SEQ ID NO: 4770 - protein, 11 aa, Homo sapiens
  Heavy chain CDR3 for antibody 2385 (IGHV3-53)
ARDLGPYGMDV

SEQ ID NO: 4771 - protein, 9 aa, Homo sapiens
  Light chain CDR3 for antibody 2386 (IGKV1-33)
QQYDNLPLT

SEQ ID NO: 4772 - protein, 11 aa, Homo sapiens
  Heavy chain CDR3 for antibody 2386 (IGHV3-53)
ARDGRGDLWSY

SEQ ID NO: 4773 - protein, 8 aa, Homo sapiens
  Light chain CDR3 for antibody 2387 (IGKV1-33)
QQYDNLPS

SEQ ID NO: 4774 - protein, 18 aa, Homo sapiens
  Heavy chain CDR3 for antibody 2387 (IGHV1-69)
ARGAGIVGAIGRHSFFNY

SEQ ID NO: 4775 - protein, 9 aa, Homo sapiens
  Light chain CDR3 for antibody 2388 (IGKV3-20)
QQYGSSLYT

SEQ ID NO: 4776 - protein, 16 aa, Homo sapiens
  Heavy chain CDR3 for antibody 2388 (IGHV1-18)
ARANPGAVGYYYGMDV

SEQ ID NO: 4777 - protein, 9 aa, Homo sapiens
  Light chain CDR3 for antibody 2389 (IGKV1-33)
QQYDNLPIT

SEQ ID NO: 4778 - protein, 14 aa, Homo sapiens
  Heavy chain CDR3 for antibody 2389 (IGHV3-23)
AKALAAAGYDAFDI

SEQ ID NO: 4779 - protein, 9 aa, Homo sapiens
  Light chain CDR3 for antibody 2390 (IGKV1-33)
QQYDNLPLT

SEQ ID NO: 4780 - protein, 11 aa, Homo sapiens
  Heavy chain CDR3 for antibody 2390 (IGHV3-53)
ARDLQVYGMDV

SEQ ID NO: 4781 - protein, 9 aa, Homo sapiens
  Light chain CDR3 for antibody 2391 (IGKV1-33)
QQYDNLPLT

SEQ ID NO: 4782 - protein, 9 aa, Homo sapiens
  Heavy chain CDR3 for antibody 2391 (IGHV3-53)
ARESYGMDV

SEQ ID NO: 4783 - protein, 9 aa, Homo sapiens
  Light chain CDR3 for antibody 2392 (IGKV1-9)
QQLNSYPPP

SEQ ID NO: 4784 - protein, 9 aa, Homo sapiens
  Heavy chain CDR3 for antibody 2392 (IGHV3-53)
ARESYGMDV

SEQ ID NO: 4785 - protein, 9 aa, Homo sapiens
  Light chain CDR3 for antibody 2393 (IGKV1-9)
QQLNSYSYT

SEQ ID NO: 4786 - protein, 11 aa, Homo sapiens
  Heavy chain CDR3 for antibody 2393 (IGHV3-53)
ARDLGPYGMDV

SEQ ID NO: 4787 - protein, 9 aa, Homo sapiens
  Light chain CDR3 for antibody 2394 (IGKV1-9)
QQLNSYSYT

SEQ ID NO: 4788 - protein, 19 aa, Homo sapiens
  Heavy chain CDR3 for antibody 2394 (IGHV1-69)
ARAHRSSTSYRLGINWFDP

SEQ ID NO: 4789 - protein, 9 aa, Homo sapiens
  Light chain CDR3 for antibody 2395 (IGKV3-11)
QQRRNWPLT

SEQ ID NO: 4790 - protein, 16 aa, Homo sapiens
  Heavy chain CDR3 for antibody 2395 (IGHV3-23)
AKDRMTAPLHYWYFDL

SEQ ID NO: 4791 - protein, 9 aa, Homo sapiens
  Light chain CDR3 for antibody 2396 (IGKV1-39)
QQSYSTPPT

SEQ ID NO: 4792 - protein, 11 aa, Homo sapiens
  Heavy chain CDR3 for antibody 2396 (IGHV3-53)
ARDLQVYGMDV

SEQ ID NO: 4793 - protein, 9 aa, Homo sapiens
  Light chain CDR3 for antibody 2397 (IGKV1-33)
QQYDNLPLT

SEQ ID NO: 4794 - protein, 19 aa, Homo sapiens
  Heavy chain CDR3 for antibody 2397 (IGHV1-69)
ARAHRSSTSYRLGINWFDP

SEQ ID NO: 4795 - protein, 8 aa, Homo sapiens
  Light chain CDR3 for antibody 2398 (IGKV1-33)
QQYDNLPS

SEQ ID NO: 4796 - protein, 19 aa, Homo sapiens
  Heavy chain CDR3 for antibody 2398 (IGHV1-69)
ARAHRSSTSYRLGINWFDP

SEQ ID NO: 4797 - protein, 9 aa, Homo sapiens
  Light chain CDR3 for antibody 2399 (IGKV1-39)
QQSYSTPPT

SEQ ID NO: 4798 - protein, 13 aa, Homo sapiens
  Heavy chain CDR3 for antibody 2399 (IGHV4-31)
ARDYGGNSAQFGY

SEQ ID NO: 4799 - protein, 10 aa, Homo sapiens
  Light chain CDR3 for antibody 2400 (IGKV3-20)
QQYGSSPPDT

SEQ ID NO: 4800 - protein, 13 aa, Homo sapiens
  Heavy chain CDR3 for antibody 2400 (IGHV5-51)
ARRYSGFHAELDY

SEQ ID NO: 4801 - protein, 9 aa, Homo sapiens
  Light chain CDR3 for antibody 2401 (IGKV1-39)
QQSYSTPPT

SEQ ID NO: 4802 - protein, 9 aa, Homo sapiens
  Heavy chain CDR3 for antibody 2401 (IGHV3-53)
ARESYGMDV

SEQ ID NO: 4803 - protein, 9 aa, Homo sapiens
  Light chain CDR3 for antibody 2402 (IGKV1-39)
QQSYSTPPT

SEQ ID NO: 4804 - protein, 18 aa, Homo sapiens
  Heavy chain CDR3 for antibody 2402 (IGHV1-69)
ARGAGIVGAIGRHSFFNY

SEQ ID NO: 4805 - protein, 9 aa, Homo sapiens
  Light chain CDR3 for antibody 2403 (IGKV1-12)
QQANSFPPT

SEQ ID NO: 4806 - protein, 9 aa, Homo sapiens
  Heavy chain CDR3 for antibody 2403 (IGHV3-53)
ARESYGMDV

SEQ ID NO: 4807 - protein, 9 aa, Homo sapiens
  Light chain CDR3 for antibody 2404 (IGKV1-9)
QQLTSYSYT

SEQ ID NO: 4808 - protein, 11 aa, Homo sapiens
  Heavy chain CDR3 for antibody 2404 (IGHV3-53)
ARDLQVYGMDV

SEQ ID NO: 4809 - protein, 9 aa, Homo sapiens
  Light chain CDR3 for antibody 2405 (IGKV3-20)
QQYGSSPDT

SEQ ID NO: 4810 - protein, 11 aa, Homo sapiens
  Heavy chain CDR3 for antibody 2405 (IGHV5-51)
ATLDYGGALPY

SEQ ID NO: 4811 - protein, 9 aa, Homo sapiens
  Light chain CDR3 for antibody 2406 (IGKV3-20)
QQYGSSPET

SEQ ID NO: 4812 - protein, 13 aa, Homo sapiens
  Heavy chain CDR3 for antibody 2406 (IGHV1-69)
ARFPNAALRAFDI

SEQ ID NO: 4813 - protein, 9 aa, Homo sapiens
  Light chain CDR3 for antibody 2407 (IGKV1-9)
QQYGSSPLT

SEQ ID NO: 4814 - protein, 11 aa, Homo sapiens
  Heavy chain CDR3 for antibody 2407 (IGHV3-53)
ARDLQVYGMDV

SEQ ID NO: 4815 - protein, 9 aa, Homo sapiens
  Light chain CDR3 for antibody 2408 (IGKV3-20)
QQYGSSPLT

SEQ ID NO: 4816 - protein, 20 aa, Homo sapiens
  Heavy chain CDR3 for antibody 2408 (IGHV4-39)
ARTGHLIRFLEWLPINWFDP

SEQ ID NO: 4817 - protein, 9 aa, Homo sapiens
  Light chain CDR3 for antibody 2409 (IGKV3-20)
QQYGSSPLT

SEQ ID NO: 4818 - protein, 17 aa, Homo sapiens
  Heavy chain CDR3 for antibody 2409 (IGHV4-31)
ASANRHTIFGVVGPFDY

SEQ ID NO: 4819 - protein, 9 aa, Homo sapiens
  Light chain CDR3 for antibody 2410 (IGKV1-NL1)
QQYYSTPYT

SEQ ID NO: 4820 - protein, 12 aa, Homo sapiens
  Heavy chain CDR3 for antibody 2410 (IGHV1-2)
ARMGGRGDYIDY

SEQ ID NO: 4821 - protein, 8 aa, Homo sapiens
  Light chain CDR3 for antibody 2411 (IGKV3-11)
QQRIYWWT

SEQ ID NO: 4822 - protein, 17 aa, Homo sapiens
  Heavy chain CDR3 for antibody 2411 (IGHV3-66)
AREDWNDRDVRYDWFDP

SEQ ID NO: 4823 - protein, 9 aa, Homo sapiens
  Light chain CDR3 for antibody 2412 (IGKV1-33)
QQYDNLPLT

SEQ ID NO: 4824 - protein, 18 aa, Homo sapiens
  Heavy chain CDR3 for antibody 2412 (IGHV1-69)
ARGAGIVGAIGRHSFFNY

SEQ ID NO: 4825 - protein, 9 aa, Homo sapiens
  Light chain CDR3 for antibody 2413 (IGKV1-39)
QQTNSLPRT

SEQ ID NO: 4826 - protein, 20 aa, Homo sapiens
  Heavy chain CDR3 for antibody 2413 (IGHV4-34)
ARGIPGGISPTGAPLSWLDP

SEQ ID NO: 4827 - protein, 9 aa, Homo sapiens
  Light chain CDR3 for antibody 2414 (IGKV3-20)
QKYGSSPWT

SEQ ID NO: 4828 - protein, 13 aa, Homo sapiens
  Heavy chain CDR3 for antibody 2414 (IGHV5-51)
VMSGYLSDWSAPY

SEQ ID NO: 4829 - protein, 8 aa, Homo sapiens
  Light chain CDR3 for antibody 2415 (IGKV1-33)
QQYDNLPS

SEQ ID NO: 4830 - protein, 13 aa, Homo sapiens
  Heavy chain CDR3 for antibody 2415 (IGHV4-31)
ARDYGGNSAQFGY

SEQ ID NO: 4831 - protein, 9 aa, Homo sapiens
  Light chain CDR3 for antibody 2416 (IGKV3-20)
QQYGSSLYT

SEQ ID NO: 4832 - protein, 9 aa, Homo sapiens
  Heavy chain CDR3 for antibody 2416 (IGHV3-53)
ARESYGMDV

SEQ ID NO: 4833 - protein, 8 aa, Homo sapiens
  Light chain CDR3 for antibody 2417 (IGKV1-33)
QQYDNLPS

SEQ ID NO: 4834 - protein, 9 aa, Homo sapiens
  Heavy chain CDR3 for antibody 2417 (IGHV3-53)
ARESYGMDV

SEQ ID NO: 4835 - protein, 10 aa, Homo sapiens
  Light chain CDR3 for antibody 2418 (IGKV3-11)
QQRSTWPPYT

SEQ ID NO: 4836 - protein, 11 aa, Homo sapiens
  Heavy chain CDR3 for antibody 2418 (IGHV1-2)
VKGRRGYSAEY

SEQ ID NO: 4837 - protein, 8 aa, Homo sapiens
  Light chain CDR3 for antibody 2419 (IGKV1-33)
QQYDNLPS

SEQ ID NO: 4838 - protein, 11 aa, Homo sapiens
  Heavy chain CDR3 for antibody 2419 (IGHV3-53)
ARDLQVYGMDV

SEQ ID NO: 4839 - protein, 9 aa, Homo sapiens
  Light chain CDR3 for antibody 2420 (IGKV3-20)
QQYGSSLYT

SEQ ID NO: 4840 - protein, 13 aa, Homo sapiens
  Heavy chain CDR3 for antibody 2420 (IGHV4-31)
ARDYGGNSAQFGY

SEQ ID NO: 4841 - protein, 9 aa, Homo sapiens
  Light chain CDR3 for antibody 2421 (IGKV1-9)
QQLNSYSYT

SEQ ID NO: 4842 - protein, 14 aa, Homo sapiens
  Heavy chain CDR3 for antibody 2421 (IGHV3-23)
AKALAAAGYDAFDI

SEQ ID NO: 4843 - protein, 9 aa, Homo sapiens
  Light chain CDR3 for antibody 2422 (IGKV3-20)
QQYGSSLYT

SEQ ID NO: 4844 - protein, 19 aa, Homo sapiens
  Heavy chain CDR3 for antibody 2422 (IGHV1-69)
ARAHRSSTSYRLGINWFDP

SEQ ID NO: 4845 - protein, 9 aa, Homo sapiens
  Light chain CDR3 for antibody 2423 (IGKV1-39)
QQSYSTPPT

SEQ ID NO: 4846 - protein, 16 aa, Homo sapiens
  Heavy chain CDR3 for antibody 2423 (IGHV1-18)
ARANPGAVGYYYGMDV

SEQ ID NO: 4847 - protein, 12 aa, Homo sapiens
  Light chain CDR3 for antibody 2424 (IGKV3-11)
QQRSIWPPKPLT

SEQ ID NO: 4848 - protein, 11 aa, Homo sapiens
  Heavy chain CDR3 for antibody 2424 (IGHV4-59)
ARLYGIESRDY

SEQ ID NO: 4849 - protein, 9 aa, Homo sapiens
  Light chain CDR3 for antibody 2425 (IGKV1-39)
QQSYSTPWT

SEQ ID NO: 4850 - protein, 16 aa, Homo sapiens
  Heavy chain CDR3 for antibody 2425 (IGHV1-69)
AKDRMTAPLHYWYFDL

SEQ ID NO: 4851 - protein, 9 aa, Homo sapiens
  Light chain CDR3 for antibody 2426 (IGKV1-5)
YQYKGSLYT

SEQ ID NO: 4852 - protein, 11 aa, Homo sapiens
  Heavy chain CDR3 for antibody 2426 (IGHV4/OR15-8)
ASRRITVCFDS

SEQ ID NO: 4853 - protein, 7 aa, Homo sapiens
  Light chain CDR3 for antibody 2427 (IGKV1-9)
QQLVEFT

SEQ ID NO: 4854 - protein, 11 aa, Homo sapiens
  Heavy chain CDR3 for antibody 2427 (IGHV1-46)
AGADLLGGSNH

SEQ ID NO: 4855 - protein, 9 aa, Homo sapiens
  Light chain CDR3 for antibody 2428 (IGKV1-9)
QQLNSYPQT

SEQ ID NO: 4856 - protein, 18 aa, Homo sapiens
  Heavy chain CDR3 for antibody 2428 (IGHV1-69)
ARGAGIVGAIGRHSFFNY

SEQ ID NO: 4857 - protein, 9 aa, Homo sapiens
  Light chain CDR3 for antibody 2429 (IGKV1-33)
QQYDNLPPT

SEQ ID NO: 4858 - protein, 16 aa, Homo sapiens
  Heavy chain CDR3 for antibody 2429 (IGHV5-51)
ARPFTSGSSGWYAIDY

SEQ ID NO: 4859 - protein, 9 aa, Homo sapiens
  Light chain CDR3 for antibody 2430 (IGKV3-20)
QQYGSSPLT

SEQ ID NO: 4860 - protein, 9 aa, Homo sapiens
  Heavy chain CDR3 for antibody 2430 (IGHV5-51)
AILIELADY

SEQ ID NO: 4861 - protein, 10 aa, Homo sapiens
  Light chain CDR3 for antibody 2431 (IGKV3-15)
QQYNNWPPLT

SEQ ID NO: 4862 - protein, 15 aa, Homo sapiens
  Heavy chain CDR3 for antibody 2431 (IGHV1-69)
ATDRVGTPRPSRFDY

SEQ ID NO: 4863 - protein, 9 aa, Homo sapiens
  Light chain CDR3 for antibody 2432 (IGKV1-33)
QQYDNLPLT

SEQ ID NO: 4864 - protein, 7 aa, Homo sapiens
  Heavy chain CDR3 for antibody 2432 (IGHV4-4)
ARGGTDV

SEQ ID NO: 4865 - protein, 9 aa, Homo sapiens
  Light chain CDR3 for antibody 2433 (IGKV1-9)
QQLNSYPPP

SEQ ID NO: 4866 - protein, 19 aa, Homo sapiens
  Heavy chain CDR3 for antibody 2433 (IGHV1-69)
ARAHRSSTSYRLGINWFDP

SEQ ID NO: 4867 - protein, 10 aa, Homo sapiens
  Light chain CDR3 for antibody 2434 (IGKV3-11)
QQRDNWPPIT

SEQ ID NO: 4868 - protein, 16 aa, Homo sapiens
  Heavy chain CDR3 for antibody 2434 (IGHV3-33)
VRDSGVAGRRGNYFDP

SEQ ID NO: 4869 - protein, 9 aa, Homo sapiens
  Light chain CDR3 for antibody 2435 (IGKV1-39)
QQSYSTPPT

SEQ ID NO: 4870 - protein, 11 aa, Homo sapiens
  Heavy chain CDR3 for antibody 2435 (IGHV3-53)
ARDGRGDLWSY

SEQ ID NO: 4871 - protein, 9 aa, Homo sapiens
  Light chain CDR3 for antibody 2436 (IGKV1-9)
QQLNSYPQT

SEQ ID NO: 4872 - protein, 9 aa, Homo sapiens
  Heavy chain CDR3 for antibody 2436 (IGHV3-53)
ARESYGMDV

SEQ ID NO: 4873 - protein, 9 aa, Homo sapiens
  Light chain CDR3 for antibody 2437 (IGKV1-NL1)
QQYYSTPWT

SEQ ID NO: 4874 - protein, 13 aa, Homo sapiens
  Heavy chain CDR3 for antibody 2437 (IGHV3-9)
AKGYGFTTYYMDV

SEQ ID NO: 4875 - protein, 9 aa, Homo sapiens
  Light chain CDR3 for antibody 2438 (IGKV3-20)
QQYGSSPWT

SEQ ID NO: 4876 - protein, 6 aa, Homo sapiens
  Heavy chain CDR3 for antibody 2438 (IGHV4-59)
AREFDY

SEQ ID NO: 4877 - protein, 6 aa, Homo sapiens
  Light chain CDR3 for antibody 2439 (IGKV3-20)
QQYGST

SEQ ID NO: 4878 - protein, 16 aa, Homo sapiens
  Heavy chain CDR3 for antibody 2439 (IGHV5-a)
ARHWSPVVVRGSEPDY

SEQ ID NO: 4879 - protein, 11 aa, Homo sapiens
  Light chain CDR3 for antibody 2440 (IGKV3-15)
QQYNNWPPMYT

SEQ ID NO: 4880 - protein, 12 aa, Homo sapiens
  Heavy chain CDR3 for antibody 2440 (IGHV3-53)
ARDLGSVGATDY

SEQ ID NO: 4881 - protein, 8 aa, Homo sapiens
  Light chain CDR3 for antibody 2441 (IGKV3-11)
QQRSNWPS

SEQ ID NO: 4882 - protein, 21 aa, Homo sapiens
  Heavy chain CDR3 for antibody 2441 (IGHV3-11)
AREFFYDSSGYYSYYYYGMDV

SEQ ID NO: 4883 - protein, 9 aa, Homo sapiens
  Light chain CDR3 for antibody 2442 (IGKV1-16)
QQYNSYPFT

SEQ ID NO: 4884 - protein, 15 aa, Homo sapiens
  Heavy chain CDR3 for antibody 2442 (IGHV1-46)
LRGGHHSGLGSPWGY

SEQ ID NO: 4885 - protein, 10 aa, Homo sapiens
  Light chain CDR3 for antibody 2443 (IGKV3-20)
QQYDDSPPWT

SEQ ID NO: 4886 - protein, 14 aa, Homo sapiens
  Heavy chain CDR3 for antibody 2443 (IGHV6-1)
ARGQHGNYVALFDP

SEQ ID NO: 4887 - protein, 9 aa, Homo sapiens
  Light chain CDR3 for antibody 2444 (IGKV3-20)
QQYGSSPRT

SEQ ID NO: 4888 - protein, 20 aa, Homo sapiens
  Heavy chain CDR3 for antibody 2444 (IGHV4-59)
ARDGDSYDFWSGYGGYGMDV

SEQ ID NO: 4889 - protein, 9 aa, Homo sapiens
  Light chain CDR3 for antibody 2445 (IGKV1-12)
QQAHSIPLT

SEQ ID NO: 4890 - protein, 13 aa, Homo sapiens
  Heavy chain CDR3 for antibody 2445 (IGHV3-23)
AKHRVSATDGFDI

SEQ ID NO: 4891 - protein, 9 aa, Homo sapiens
  Light chain CDR3 for antibody 2446 (IGKV1-39)
QQSYSTLLT

SEQ ID NO: 4892 - protein, 19 aa, Homo sapiens
  Heavy chain CDR3 for antibody 2446 (IGHV4/OR15-8)
ARDALGYCSGGRCYAAFDI

SEQ ID NO: 4893 - protein, 9 aa, Homo sapiens
  Light chain CDR3 for antibody 2447 (IGKV3-20)
QQYGSSPLT

SEQ ID NO: 4894 - protein, 13 aa, Homo sapiens
  Heavy chain CDR3 for antibody 2447 (IGHV1-69)
ARSVVGSGSNFDY

SEQ ID NO: 4895 - protein, 9 aa, Homo sapiens
  Light chain CDR3 for antibody 2448 (IGKV1-39)
QQSFTFPFT

SEQ ID NO: 4896 - protein, 16 aa, Homo sapiens
  Heavy chain CDR3 for antibody 2448 (IGHV1-8)
AGEPLGAPAAVNRFDS

SEQ ID NO: 4897 - protein, 9 aa, Homo sapiens
  Light chain CDR3 for antibody 2449 (IGKV1-39)
QQSYSTPPT

SEQ ID NO: 4898 - protein, 19 aa, Homo sapiens
  Heavy chain CDR3 for antibody 2449 (IGHV1-69)
ARARGSSASYRLGINWFDA

SEQ ID NO: 4899 - protein, 9 aa, Homo sapiens
  Light chain CDR3 for antibody 2450 (IGKV1-9)
QQLNSYSYT

SEQ ID NO: 4900 - protein, 16 aa, Homo sapiens
  Heavy chain CDR3 for antibody 2450 (IGHV3-23)
AKDRMTAPLHYWYFDL

SEQ ID NO: 4901 - protein, 9 aa, Homo sapiens
  Light chain CDR3 for antibody 2451 (IGKV1-33)
QQYDNLPLT

SEQ ID NO: 4902 - protein, 16 aa, Homo sapiens
  Heavy chain CDR3 for antibody 2451 (IGHV1-18)
ARANPGAVGYYYGMDV

SEQ ID NO: 4903 - protein, 9 aa, Homo sapiens
  Light chain CDR3 for antibody 2452 (IGKV1-9)
QQLTSYSYT

SEQ ID NO: 4904 - protein, 13 aa, Homo sapiens
  Heavy chain CDR3 for antibody 2452 (IGHV4-31)
ARDYGGNSAQFGY

SEQ ID NO: 4905 - protein, 8 aa, Homo sapiens
  Light chain CDR3 for antibody 2453 (IGKV3-20)
QQYGTSLP

SEQ ID NO: 4906 - protein, 17 aa, Homo sapiens
  Heavy chain CDR3 for antibody 2453 (IGHV1-69)
ARWAGTPTSRWSGPADY

SEQ ID NO: 4907 - protein, 10 aa, Homo sapiens
  Light chain CDR3 for antibody 2454 (IGKV1-33)
QQYDNLPMYT

SEQ ID NO: 4908 - protein, 21 aa, Homo sapiens
  Heavy chain CDR3 for antibody 2454 (IGHV4-31)
ARDGGEFLEWLSSRGPGWFDP

SEQ ID NO: 4909 - protein, 10 aa, Homo sapiens
  Light chain CDR3 for antibody 2455 (IGKV1-39)
QQSYDTPEWT

SEQ ID NO: 4910 - protein, 14 aa, Homo sapiens
  Heavy chain CDR3 for antibody 2455 (IGHV5-51)
VRQVVRGVEGRFDP

SEQ ID NO: 4911 - protein, 9 aa, Homo sapiens
  Light chain CDR3 for antibody 2456 (IGKV1-39)
QQSYSTLGT

SEQ ID NO: 4912 - protein, 13 aa, Homo sapiens
  Heavy chain CDR3 for antibody 2456 (IGHV4-34)
AREWVRYYYYMDV

SEQ ID NO: 4913 - protein, 10 aa, Homo sapiens
  Light chain CDR3 for antibody 2457 (IGKV3-11)
QQRSNWPPLT

SEQ ID NO: 4914 - protein, 14 aa, Homo sapiens
  Heavy chain CDR3 for antibody 2457 (IGHV1-8)
ARGFGGWGNYYMDV

SEQ ID NO: 4915 - protein, 9 aa, Homo sapiens
  Light chain CDR3 for antibody 2458 (IGKV1-12)
QQANGFPLT

SEQ ID NO: 4916 - protein, 12 aa, Homo sapiens
  Heavy chain CDR3 for antibody 2458 (IGHV2-5)
GYRGGARAWFGP

SEQ ID NO: 4917 - protein, 9 aa, Homo sapiens
  Light chain CDR3 for antibody 2459 (IGKV1-16)
QQYNSYPLT

SEQ ID NO: 4918 - protein, 13 aa, Homo sapiens
  Heavy chain CDR3 for antibody 2459 (IGHV1-24)
ATTPVPRYFDWFV

SEQ ID NO: 4919 - protein, 9 aa, Homo sapiens
  Light chain CDR3 for antibody 2460 (IGKV3-20)
QQYGSSPVT

SEQ ID NO: 4920 - protein, 13 aa, Homo sapiens
  Heavy chain CDR3 for antibody 2460 (IGHV1-69)
ASVVLGRLDGYAY

SEQ ID NO: 4921 - protein, 9 aa, Homo sapiens
  Light chain CDR3 for antibody 2461 (IGKV1-12)
QQANSFPPT

SEQ ID NO: 4922 - protein, 11 aa, Homo sapiens
  Heavy chain CDR3 for antibody 2461 (IGHV3-53)
ARDLQVYGMDV

SEQ ID NO: 4923 - protein, 9 aa, Homo sapiens
  Light chain CDR3 for antibody 2462 (IGKV2D-28)
MQALQTPLT

SEQ ID NO: 4924 - protein, 16 aa, Homo sapiens
  Heavy chain CDR3 for antibody 2462 (IGHV4/OR15-8)
ARYATAPIKQYNWFDP

SEQ ID NO: 4925 - protein, 9 aa, Homo sapiens
  Light chain CDR3 for antibody 2463 (IGKV3-20)
QQYGSSLYT

SEQ ID NO: 4926 - protein, 18 aa, Homo sapiens
  Heavy chain CDR3 for antibody 2463 (IGHV4-34)
ARGAYSSSWYGVRSWFDP

SEQ ID NO: 4927 - protein, 9 aa, Homo sapiens
  Light chain CDR3 for antibody 2464 (IGKV3-20)
QQYGSSPLA

SEQ ID NO: 4928 - protein, 18 aa, Homo sapiens
  Heavy chain CDR3 for antibody 2464 (IGHV4-34)
ARGGNTIFGVVIIGAFDY

SEQ ID NO: 4929 - protein, 9 aa, Homo sapiens
  Light chain CDR3 for antibody 2465 (IGKV1-33)
QQYDNLPIT

SEQ ID NO: 4930 - protein, 11 aa, Homo sapiens
  Heavy chain CDR3 for antibody 2465 (IGHV3-53)
ARDLGPYGMDV

SEQ ID NO: 4931 - protein, 9 aa, Homo sapiens
  Light chain CDR3 for antibody 2466 (IGKV1-9)
QQLNSYSYT

SEQ ID NO: 4932 - protein, 11 aa, Homo sapiens
  Heavy chain CDR3 for antibody 2466 (IGHV3-53)
ARDGRGDLWAY

SEQ ID NO: 4933 - protein, 10 aa, Homo sapiens
  Light chain CDR3 for antibody 2467 (IGKV4-1)
QQYYSTSTWT

SEQ ID NO: 4934 - protein, 12 aa, Homo sapiens
  Heavy chain CDR3 for antibody 2467 (IGHV1-18)
AKTTPLVTTLGY

SEQ ID NO: 4935 - protein, 8 aa, Homo sapiens
  Light chain CDR3 for antibody 2468 (IGKV3-11)
QQRSNWLT

SEQ ID NO: 4936 - protein, 16 aa, Homo sapiens
  Heavy chain CDR3 for antibody 2468 (IGHV4-31)
ARASRGIFGVVEWSDP

SEQ ID NO: 4937 - protein, 9 aa, Homo sapiens
  Light chain CDR3 for antibody 2469 (IGKV1-9)
QQLNSYPQT

SEQ ID NO: 4938 - protein, 19 aa, Homo sapiens
  Heavy chain CDR3 for antibody 2469 (IGHV1-69)
ARAHRSSTSYRLGINWFDP

SEQ ID NO: 4939 - protein, 9 aa, Homo sapiens
  Light chain CDR3 for antibody 2470 (IGKV1-9)
QQLNSYPQT

SEQ ID NO: 4940 - protein, 16 aa, Homo sapiens
  Heavy chain CDR3 for antibody 2470 (IGHV1-18)
ARANPGAVGYYYGMDV

SEQ ID NO: 4941 - protein, 9 aa, Homo sapiens
  Light chain CDR3 for antibody 2471 (IGKV1-9)
QQLNSYPPP

SEQ ID NO: 4942 - protein, 11 aa, Homo sapiens
  Heavy chain CDR3 for antibody 2471 (IGHV3-53)
ARDIQVYGMDV

SEQ ID NO: 4943 - protein, 9 aa, Homo sapiens
  Light chain CDR3 for antibody 2472 (IGKV1D-16)
LQHYTFPYT

SEQ ID NO: 4944 - protein, 16 aa, Homo sapiens
  Heavy chain CDR3 for antibody 2472 (IGHV3-48)
ATDRPGFCGDGSCWET

SEQ ID NO: 4945 - protein, 10 aa, Homo sapiens
  Light chain CDR3 for antibody 2473 (IGKV2-30)
MQGTHWLPWT

SEQ ID NO: 4946 - protein, 16 aa, Homo sapiens
  Heavy chain CDR3 for antibody 2473 (IGHV1-8)
ARGGRYYDFWSGYSVY

SEQ ID NO: 4947 - protein, 9 aa, Homo sapiens
  Light chain CDR3 for antibody 2474 (IGKV3-11)
QQRRNWPLT

SEQ ID NO: 4948 - protein, 11 aa, Homo sapiens
  Heavy chain CDR3 for antibody 2474 (IGHV3-53)
ARDLQVYGMDV

SEQ ID NO: 4949 - protein, 9 aa, Homo sapiens
  Light chain CDR3 for antibody 2475 (IGKV2-30)
MQGTHWPET

SEQ ID NO: 4950 - protein, 7 aa, Homo sapiens
  Heavy chain CDR3 for antibody 2475 (IGHV1-69)
ASGGGGY

SEQ ID NO: 4951 - protein, 9 aa, Homo sapiens
  Light chain CDR3 for antibody 2476 (IGKV3-11)
QQRRNWPLT

SEQ ID NO: 4952 - protein, 13 aa, Homo sapiens
  Heavy chain CDR3 for antibody 2476 (IGHV4-31)
ARDYGGNSAQFGY

SEQ ID NO: 4953 - protein, 11 aa, Homo sapiens
  Light chain CDR3 for antibody 2477 (IGKV3-15)
QQYNNWPPMYT

SEQ ID NO: 4954 - protein, 9 aa, Homo sapiens
  Heavy chain CDR3 for antibody 2477 (IGHV4-39)
AEIVGATDY

SEQ ID NO: 4955 - protein, 9 aa, Homo sapiens
  Light chain CDR3 for antibody 2478 (IGKV1-33)
QQYDNLPLT

SEQ ID NO: 4956 - protein, 21 aa, Homo sapiens
  Heavy chain CDR3 for antibody 2478 (IGHV1-46)
ARTTVAGSSVTVRRPVYGMDV

SEQ ID NO: 4957 - protein, 8 aa, Homo sapiens
  Light chain CDR3 for antibody 2479 (IGKV1-33)
QQYDNLPS

SEQ ID NO: 4958 - protein, 16 aa, Homo sapiens
  Heavy chain CDR3 for antibody 2479 (IGHV1-18)
ARANPGAVGYYYGMDV

SEQ ID NO: 4959 - protein, 10 aa, Homo sapiens
  Light chain CDR3 for antibody 2480 (IGKV3-20)
QQYGSSPIFT

SEQ ID NO: 4960 - protein, 14 aa, Homo sapiens
  Heavy chain CDR3 for antibody 2480 (IGHV3-33)
ARDGGYSGYAYFDY

SEQ ID NO: 4961 - protein, 9 aa, Homo sapiens
  Light chain CDR3 for antibody 2481 (IGKV1-9)
QQLNSYPPP

SEQ ID NO: 4962 - protein, 11 aa, Homo sapiens
  Heavy chain CDR3 for antibody 2481 (IGHV3-53)
ARGVGTYGMDV

SEQ ID NO: 4963 - protein, 9 aa, Homo sapiens
  Light chain CDR3 for antibody 2482 (IGKV3-20)
QQYGSSPLT

SEQ ID NO: 4964 - protein, 17 aa, Homo sapiens
  Heavy chain CDR3 for antibody 2482 (IGHV4-31)
ARGRIGTIFGVVGPFDY

SEQ ID NO: 4965 - protein, 9 aa, Homo sapiens
  Light chain CDR3 for antibody 2483 (IGKV1-33)
QQYDNLLLT

SEQ ID NO: 4966 - protein, 15 aa, Homo sapiens
  Heavy chain CDR3 for antibody 2483 (IGHV5-51)
ARLYGVVTAIEYFQH

SEQ ID NO: 4967 - protein, 10 aa, Homo sapiens
  Light chain CDR3 for antibody 2484 (IGKV1-39)
QQSYSTLRGT

SEQ ID NO: 4968 - protein, 19 aa, Homo sapiens
  Heavy chain CDR3 for antibody 2484 (IGHV1-24)
ATDRGGVPLGLGFGAIFDY

SEQ ID NO: 4969 - protein, 11 aa, Homo sapiens
  Light chain CDR3 for antibody 2485 (IGKV3-20)
QQYGSSPPLRT

SEQ ID NO: 4970 - protein, 23 aa, Homo sapiens
  Heavy chain CDR3 for antibody 2485 (IGHV1-18)
ARERDDFWSGYPLTYYYYYGMDV

SEQ ID NO: 4971 - protein, 8 aa, Homo sapiens
  Light chain CDR3 for antibody 2486 (IGKV1-33)
QQYDNLPL

SEQ ID NO: 4972 - protein, 14 aa, Homo sapiens
  Heavy chain CDR3 for antibody 2486 (IGHV1-8)
ATWWSYSDRKPFDY

SEQ ID NO: 4973 - protein, 9 aa, Homo sapiens
  Light chain CDR3 for antibody 2487 (IGKV3-20)
QQYGSSPLT

SEQ ID NO: 4974 - protein, 16 aa, Homo sapiens
  Heavy chain CDR3 for antibody 2487 (IGHV4-31)
ARARITMIVVVSHFDY

SEQ ID NO: 4975 - protein, 9 aa, Homo sapiens
  Light chain CDR3 for antibody 2488 (IGKV3-11)
QQRRNWPLT

SEQ ID NO: 4976 - protein, 9 aa, Homo sapiens
  Heavy chain CDR3 for antibody 2488 (IGHV3-53)
ARESYGMDV

SEQ ID NO: 4977 - protein, 9 aa, Homo sapiens
  Light chain CDR3 for antibody 2489 (IGKV1-33)
QQYDNLPPT

SEQ ID NO: 4978 - protein, 13 aa, Homo sapiens
  Heavy chain CDR3 for antibody 2489 (IGHV4-31)
ARDYGGSSAHFDY

SEQ ID NO: 4979 - protein, 8 aa, Homo sapiens
  Light chain CDR3 for antibody 2490 (IGKV1-33)
QQYDNLPS

SEQ ID NO: 4980 - protein, 11 aa, Homo sapiens
  Heavy chain CDR3 for antibody 2490 (IGHV1-69)
ARDGRGDLWSY

SEQ ID NO: 4981 - protein, 9 aa, Homo sapiens
  Light chain CDR3 for antibody 2491 (IGKV3-20)
QQYGSSPYT

SEQ ID NO: 4982 - protein, 14 aa, Homo sapiens
  Heavy chain CDR3 for antibody 2491 (IGHV1-69)
ARARDYYYYYGMDV

SEQ ID NO: 4983 - protein, 9 aa, Homo sapiens
  Light chain CDR3 for antibody 2492 (IGKV3-20)
QQYGSSLYT

SEQ ID NO: 4984 - protein, 11 aa, Homo sapiens
  Heavy chain CDR3 for antibody 2492 (IGHV1-18)
ARDLGPYGMDV

SEQ ID NO: 4985 - protein, 10 aa, Homo sapiens
  Light chain CDR3 for antibody 2493 (IGKV2-30)
VQGTHWPRYT

SEQ ID NO: 4986 - protein, 16 aa, Homo sapiens
  Heavy chain CDR3 for antibody 2493 (IGHV5-51)
ARLRAGGAGGTGDFDS

SEQ ID NO: 4987 - protein, 9 aa, Homo sapiens
  Light chain CDR3 for antibody 2494 (IGKV1-33)
QQYDNLPLT

SEQ ID NO: 4988 - protein, 13 aa, Homo sapiens
  Heavy chain CDR3 for antibody 2494 (IGHV5-51)
ARRYSGFHAELDY

SEQ ID NO: 4989 - protein, 9 aa, Homo sapiens
  Light chain CDR3 for antibody 2495 (IGKV3-11)
QQRRNWPLT

SEQ ID NO: 4990 - protein, 19 aa, Homo sapiens
  Heavy chain CDR3 for antibody 2495 (IGHV1-69)
ARAHRSSTSYRLGINWFDP

SEQ ID NO: 4991 - protein, 8 aa, Homo sapiens
  Light chain CDR3 for antibody 2496 (IGKV3-20)
QQYGSSPP

SEQ ID NO: 4992 - protein, 19 aa, Homo sapiens
  Heavy chain CDR3 for antibody 2496 (IGHV1-69)
ARGGWGTVVTPRGYYYMDV

SEQ ID NO: 4993 - protein, 9 aa, Homo sapiens
  Light chain CDR3 for antibody 2497 (IGKV3-20)
QQYGSSLYT

SEQ ID NO: 4994 - protein, 18 aa, Homo sapiens
  Heavy chain CDR3 for antibody 2497 (IGHV1-69)
ARGAGIVGAIGRHSFFNY

SEQ ID NO: 4995 - protein, 9 aa, Homo sapiens
  Light chain CDR3 for antibody 2498 (IGKV1-9)
QQLNSYPPP

SEQ ID NO: 4996 - protein, 12 aa, Homo sapiens
  Heavy chain CDR3 for antibody 2498 (IGHV3-53)
ARDLGSVGATDY

SEQ ID NO: 4997 - protein, 9 aa, Homo sapiens
  Light chain CDR3 for antibody 2499 (IGKV1-9)
QQLNSYPQT

SEQ ID NO: 4998 - protein, 13 aa, Homo sapiens
  Heavy chain CDR3 for antibody 2499 (IGHV5-51)
ARRYSGFHAELDY

SEQ ID NO: 4999 - protein, 9 aa, Homo sapiens
  Light chain CDR3 for antibody 2500 (IGKV1-39)
QQSYSTPPT

SEQ ID NO: 5000 - protein, 13 aa, Homo sapiens
  Heavy chain CDR3 for antibody 2500 (IGHV5-51)
ARRYSGFHAELDY

SEQ ID NO: 5001 - protein, 9 aa, Homo sapiens
  Light chain CDR3 for antibody 2501 (IGKV3-20)
QQYGSSPRT

SEQ ID NO: 5002 - protein, 19 aa, Homo sapiens
  Heavy chain CDR3 for antibody 2501 (IGHV4-59)
ARDRHYTIFGVVIEHYFDY

SEQ ID NO: 5003 - protein, 9 aa, Homo sapiens
  Light chain CDR3 for antibody 2502 (IGKV1-39)
QQSYSTPPT

SEQ ID NO: 5004 - protein, 19 aa, Homo sapiens
  Heavy chain CDR3 for antibody 2502 (IGHV1-46)
ARAARNSTSYRLGINWFDH

SEQ ID NO: 5005 - protein, 9 aa, Homo sapiens
  Light chain CDR3 for antibody 2503 (IGKV3-20)
QQYGSSPYT

SEQ ID NO: 5006 - protein, 11 aa, Homo sapiens
  Heavy chain CDR3 for antibody 2503 (IGHV3-53)
ARDGRGDLWSY

SEQ ID NO: 5007 - protein, 8 aa, Homo sapiens
  Light chain CDR3 for antibody 2504 (IGKV1-5)
QQYRSYWT

SEQ ID NO: 5008 - protein, 17 aa, Homo sapiens
  Heavy chain CDR3 for antibody 2504 (IGHV3-66)
VKDGGTIYDVVNAPLDD

SEQ ID NO: 5009 - protein, 9 aa, Homo sapiens
  Light chain CDR3 for antibody 2505 (IGKV1-9)
QQLNSYPQT

SEQ ID NO: 5010 - protein, 11 aa, Homo sapiens
  Heavy chain CDR3 for antibody 2505 (IGHV3-53)
ARDLHMYCMDV

SEQ ID NO: 5011 - protein, 9 aa, Homo sapiens
  Light chain CDR3 for antibody 2506 (IGKV1-9)
QQLNSYPQT

SEQ ID NO: 5012 - protein, 11 aa, Homo sapiens
  Heavy chain CDR3 for antibody 2506 (IGHV3-66)
TIDLQMYCMDV

SEQ ID NO: 5013 - protein, 9 aa, Homo sapiens
  Light chain CDR3 for antibody 2507 (IGKV1-33)
QQYDNLPLT

SEQ ID NO: 5014 - protein, 13 aa, Homo sapiens
  Heavy chain CDR3 for antibody 2507 (IGHV4-34)
AREWVRYYYYMDV

SEQ ID NO: 5015 - protein, 9 aa, Homo sapiens
  Light chain CDR3 for antibody 2508 (IGKV1-9)
QQLNSYPYT

SEQ ID NO: 5016 - protein, 12 aa, Homo sapiens
  Heavy chain CDR3 for antibody 2508 (IGHV1-2)
ARMGGRGDYIDY

SEQ ID NO: 5017 - protein, 9 aa, Homo sapiens
  Light chain CDR3 for antibody 2509 (IGKV1-9)
QQLNSYPQT

SEQ ID NO: 5018 - protein, 17 aa, Homo sapiens
  Heavy chain CDR3 for antibody 2509 (IGHV3-66)
AREDWNDRDVRYDWFDP

SEQ ID NO: 5019 - protein, 8 aa, Homo sapiens
  Light chain CDR3 for antibody 2510 (IGKV3-11)
QQRSNWPS

SEQ ID NO: 5020 - protein, 11 aa, Homo sapiens
  Heavy chain CDR3 for antibody 2510 (IGHV1-69)
ARDLQPYGMDV

SEQ ID NO: 5021 - protein, 10 aa, Homo sapiens
  Light chain CDR3 for antibody 2511 (IGKV3-20)
QQYGSSPSWT

SEQ ID NO: 5022 - protein, 26 aa, Homo sapiens
  Heavy chain CDR3 for antibody 2511 (IGHV4-b)
ASATPHYYDSSGYYYEAFHYYYYMDV

SEQ ID NO: 5023 - protein, 9 aa, Homo sapiens
  Light chain CDR3 for antibody 2512 (IGKV1-39)
QQSYSTPPT

SEQ ID NO: 5024 - protein, 19 aa, Homo sapiens
  Heavy chain CDR3 for antibody 2512 (IGHV1-69)
ARADRGSTSYRLGISWFDP

SEQ ID NO: 5025 - protein, 9 aa, Homo sapiens
  Light chain CDR3 for antibody 2513 (IGKV1-39)
QQSYSTPPT

SEQ ID NO: 5026 - protein, 14 aa, Homo sapiens
  Heavy chain CDR3 for antibody 2513 (IGHV3-23)
AKALAAAGYDAFDI

SEQ ID NO: 5027 - protein, 9 aa, Homo sapiens
  Light chain CDR3 for antibody 2514 (IGKV1-9)
QQLNSYPQT

SEQ ID NO: 5028 - protein, 11 aa, Homo sapiens
  Heavy chain CDR3 for antibody 2514 (IGHV3-53)
ARDLHIYYLDV

SEQ ID NO: 5029 - protein, 9 aa, Homo sapiens
  Light chain CDR3 for antibody 2515 (IGKV1-9)
QQLNSYPQT

SEQ ID NO: 5030 - protein, 11 aa, Homo sapiens
  Heavy chain CDR3 for antibody 2515 (IGHV3-53)
ARDRGPYGMDV

SEQ ID NO: 5031 - protein, 9 aa, Homo sapiens
  Light chain CDR3 for antibody 2516 (IGKV1-12)
QQANSFPYT

SEQ ID NO: 5032 - protein, 15 aa, Homo sapiens
  Heavy chain CDR3 for antibody 2516 (IGHV1-69)
ARDWTDSTVTGYFDL

SEQ ID NO: 5033 - protein, 9 aa, Homo sapiens
  Light chain CDR3 for antibody 2517 (IGKV1-9)
QQLNSYPQT

SEQ ID NO: 5034 - protein, 19 aa, Homo sapiens
  Heavy chain CDR3 for antibody 2517 (IGHV3-53)
ARADRSSTSYRLGINWLDP

SEQ ID NO: 5035 - protein, 9 aa, Homo sapiens
  Light chain CDR3 for antibody 2518 (IGKV1-5)
QQYSSYPRT

SEQ ID NO: 5036 - protein, 11 aa, Homo sapiens
  Heavy chain CDR3 for antibody 2518 (IGHV3-21)
ARTYALGSFEY

SEQ ID NO: 5037 - protein, 9 aa, Homo sapiens
  Light chain CDR3 for antibody 2519 (IGKV1-9)
QQLNSYPPP

SEQ ID NO: 5038 - protein, 16 aa, Homo sapiens
  Heavy chain CDR3 for antibody 2519 (IGHV1-18)
ARANPEAVGYYYGMDV

SEQ ID NO: 5039 - protein, 11 aa, Homo sapiens
  Light chain CDR3 for antibody 2520 (IGKV3-11)
QQTNGWPPTIA

SEQ ID NO: 5040 - protein, 15 aa, Homo sapiens
  Heavy chain CDR3 for antibody 2520 (IGHV1-46)
ARLPNIALAATGFDS

SEQ ID NO: 5041 - protein, 9 aa, Homo sapiens
  Light chain CDR3 for antibody 2521 (IGKV2-30)
MKGTHWPPD

SEQ ID NO: 5042 - protein, 15 aa, Homo sapiens
  Heavy chain CDR3 for antibody 2521 (IGHV1-69)
ATDRVGTPRPSRFDY

SEQ ID NO: 5043 - protein, 9 aa, Homo sapiens
  Light chain CDR3 for antibody 2522 (IGKV1-12)
QQADSFPWP

SEQ ID NO: 5044 - protein, 16 aa, Homo sapiens
  Heavy chain CDR3 for antibody 2522 (IGHV3-23)
AKPRQVMAAHFDGFDY

SEQ ID NO: 5045 - protein, 8 aa, Homo sapiens
  Light chain CDR3 for antibody 2523 (IGKV1-5)
QKYNSYWT

SEQ ID NO: 5046 - protein, 18 aa, Homo sapiens
  Heavy chain CDR3 for antibody 2523 (IGHV3-53)
ARGMNDFWSGSEFSGMDV

SEQ ID NO: 5047 - protein, 9 aa, Homo sapiens
  Light chain CDR3 for antibody 2524 (IGKV1-33)
QQYDNLPLT

SEQ ID NO: 5048 - protein, 11 aa, Homo sapiens
  Heavy chain CDR3 for antibody 2524 (IGHV4/OR15-8)
ASRRITGCFDS

SEQ ID NO: 5049 - protein, 9 aa, Homo sapiens
  Light chain CDR3 for antibody 2525 (IGKV1-39)
QQSYSTPPT

SEQ ID NO: 5050 - protein, 19 aa, Homo sapiens
  Heavy chain CDR3 for antibody 2525 (IGHV1-69)
ARANRSSTSYRLGINCCDH

SEQ ID NO: 5051 - protein, 9 aa, Homo sapiens
  Light chain CDR3 for antibody 2526 (IGKV2D-28)
MQGLEAPWT

SEQ ID NO: 5052 - protein, 16 aa, Homo sapiens
  Heavy chain CDR3 for antibody 2526 (IGHV3-74)
ARGQRDPNYHYHGADV

SEQ ID NO: 5053 - protein, 9 aa, Homo sapiens
  Light chain CDR3 for antibody 2527 (IGKV1D-12)
QQAHSFPYT

SEQ ID NO: 5054 - protein, 20 aa, Homo sapiens
  Heavy chain CDR3 for antibody 2527 (IGHV3-66)
ARRPDFDFWSGTTLAYGMDV

SEQ ID NO: 5055 - protein, 10 aa, Homo sapiens
  Light chain CDR3 for antibody 2528 (IGKV3-11)
QQRSNWPPFT

SEQ ID NO: 5056 - protein, 15 aa, Homo sapiens
  Heavy chain CDR3 for antibody 2528 (IGHV1-69)
AQQGDGYNLDDAFDI

SEQ ID NO: 5057 - protein, 9 aa, Homo sapiens
  Light chain CDR3 for antibody 2529 (IGKV3-20)
QQYGSSLLT

SEQ ID NO: 5058 - protein, 13 aa, Homo sapiens
  Heavy chain CDR3 for antibody 2529 (IGHV1-46)
ARAGTYYYYYMDV

SEQ ID NO: 5059 - protein, 9 aa, Homo sapiens
  Light chain CDR3 for antibody 2530 (IGKV3-20)
QQYGSSLYT

SEQ ID NO: 5060 - protein, 13 aa, Homo sapiens
  Heavy chain CDR3 for antibody 2530 (IGHV5-51)
ARRYSGFHAELDY

SEQ ID NO: 5061 - protein, 9 aa, Homo sapiens
  Light chain CDR3 for antibody 2531 (IGKV1-9)
QQLNSYPQT

SEQ ID NO: 5062 - protein, 11 aa, Homo sapiens
  Heavy chain CDR3 for antibody 2531 (IGHV3-53)
ARDLRVYCLDL

SEQ ID NO: 5063 - protein, 9 aa, Homo sapiens
  Light chain CDR3 for antibody 2532 (IGKV1-5)
QQYNSYPYT

SEQ ID NO: 5064 - protein, 17 aa, Homo sapiens
  Heavy chain CDR3 for antibody 2532 (IGHV4-39)
ASANRHTIFGVVGPFDY

SEQ ID NO: 5065 - protein, 9 aa, Homo sapiens
  Light chain CDR3 for antibody 2533 (IGKV1-33)
QQYDNLPLT

SEQ ID NO: 5066 - protein, 16 aa, Homo sapiens
  Heavy chain CDR3 for antibody 2533 (IGHV1-69)
AKDRMTAPLHYWYFDL

SEQ ID NO: 5067 - protein, 9 aa, Homo sapiens
  Light chain CDR3 for antibody 2534 (IGKV3-11)
QQRRNWPLT

SEQ ID NO: 5068 - protein, 18 aa, Homo sapiens
  Heavy chain CDR3 for antibody 2534 (IGHV3-h)
ARGRAWIQLWHYGVDFDY

SEQ ID NO: 5069 - protein, 8 aa, Homo sapiens
  Light chain CDR3 for antibody 2535 (IGKV1-5)
QQYVTYPT

SEQ ID NO: 5070 - protein, 18 aa, Homo sapiens
  Heavy chain CDR3 for antibody 2535 (IGHV4/OR15-8)
ARVDSAWAGTPRFWYFDL

SEQ ID NO: 5071 - protein, 9 aa, Homo sapiens
  Light chain CDR3 for antibody 2536 (IGKV1-39)
QQSYSTPPT

SEQ ID NO: 5072 - protein, 19 aa, Homo sapiens
  Heavy chain CDR3 for antibody 2536 (IGHV1-69)
ARADRSSPSYRLGINWFDP

SEQ ID NO: 5073 - protein, 9 aa, Homo sapiens
  Light chain CDR3 for antibody 2537 (IGKV1-9)
QQLNSYPQT

SEQ ID NO: 5074 - protein, 11 aa, Homo sapiens
  Heavy chain CDR3 for antibody 2537 (IGHV3-66)
ARDLQKYDIDI

SEQ ID NO: 5075 - protein, 9 aa, Homo sapiens
  Light chain CDR3 for antibody 2538 (IGKV1-39)
QQSYSTPRT

SEQ ID NO: 5076 - protein, 16 aa, Homo sapiens
  Heavy chain CDR3 for antibody 2538 (IGHV3-21)
ARVNWFGEAPRYNSDY

SEQ ID NO: 5077 - protein, 9 aa, Homo sapiens
  Light chain CDR3 for antibody 2539 (IGKV3-20)
QQYGSSPGT

SEQ ID NO: 5078 - protein, 10 aa, Homo sapiens
  Heavy chain CDR3 for antibody 2539 (IGHV3-23)
AKDQGSGWAN

SEQ ID NO: 5079 - protein, 10 aa, Homo sapiens
  Light chain CDR3 for antibody 2540 (IGKV1-33)
QQYDNLPPYT

SEQ ID NO: 5080 - protein, 16 aa, Homo sapiens
  Heavy chain CDR3 for antibody 2540 (IGHV3-30)
AKHGYSYGYWLGYFDY

SEQ ID NO: 5081 - protein, 10 aa, Homo sapiens
  Light chain CDR3 for antibody 2541 (IGKV3-11)
QQRSNWPPYT

SEQ ID NO: 5082 - protein, 13 aa, Homo sapiens
  Heavy chain CDR3 for antibody 2541 (IGHV1-69)
ATLGGDGDYVLDV

SEQ ID NO: 5083 - protein, 9 aa, Homo sapiens
  Light chain CDR3 for antibody 2542 (IGKV1D-17)
LQHNSYPYT

SEQ ID NO: 5084 - protein, 10 aa, Homo sapiens
  Heavy chain CDR3 for antibody 2542 (IGHV3-33)
ARESTDGMDV

SEQ ID NO: 5085 - protein, 9 aa, Homo sapiens
  Light chain CDR3 for antibody 2543 (IGKV1-9)
QQLNSYPFT

SEQ ID NO: 5086 - protein, 17 aa, Homo sapiens
  Heavy chain CDR3 for antibody 2543 (IGHV3-33)
AREITMVRGDNYYGMDV

SEQ ID NO: 5087 - protein, 9 aa, Homo sapiens
  Light chain CDR3 for antibody 2544 (IGKV1-9)
QQLNSYPYT

SEQ ID NO: 5088 - protein, 15 aa, Homo sapiens
  Heavy chain CDR3 for antibody 2544 (IGHV1-46)
AREKYYGSGSYPFDY

SEQ ID NO: 5089 - protein, 9 aa, Homo sapiens
  Light chain CDR3 for antibody 2545 (IGKV6-21)
HQSSSLPYT

SEQ ID NO: 5090 - protein, 16 aa, Homo sapiens
  Heavy chain CDR3 for antibody 2545 (IGHV1-18)
AREGDTMVRGVIAFDY

SEQ ID NO: 5091 - protein, 9 aa, Homo sapiens
  Light chain CDR3 for antibody 2546 (IGKV1-9)
QQLNSHPFT

SEQ ID NO: 5092 - protein, 17 aa, Homo sapiens
  Heavy chain CDR3 for antibody 2546 (IGHV3-33)
AREVTMVRGDNYYGLDV

SEQ ID NO: 5093 - protein, 9 aa, Homo sapiens
  Light chain CDR3 for antibody 2547 (IGKV1D-17)
LQHNSYPYT

SEQ ID NO: 5094 - protein, 17 aa, Homo sapiens
  Heavy chain CDR3 for antibody 2547 (IGHV3-33)
AREITMVRGDNYYGMDV

SEQ ID NO: 5095 - protein, 9 aa, Homo sapiens
  Light chain CDR3 for antibody 2548 (IGKV1-9)
QQLNSYPFT

SEQ ID NO: 5096 - protein, 10 aa, Homo sapiens
  Heavy chain CDR3 for antibody 2548 (IGHV3-33)
ARESTDGMDV

SEQ ID NO: 5097 - protein, 9 aa, Homo sapiens
  Light chain CDR3 for antibody 2549 (IGKV1-9)
QQFNSHPFT

SEQ ID NO: 5098 - protein, 17 aa, Homo sapiens
  Heavy chain CDR3 for antibody 2549 (IGHV3-33)
AREITMLRGDNYYGLDV

SEQ ID NO: 5099 - protein, 9 aa, Homo sapiens
  Light chain CDR3 for antibody 2550 (IGKV1D-17)
LQHNSYPYT

SEQ ID NO: 5100 - protein, 10 aa, Homo sapiens
  Heavy chain CDR3 for antibody 2550 (IGHV3-33)
AREGRTGFDY

SEQ ID NO: 5101 - protein, 9 aa, Homo sapiens
  Light chain CDR3 for antibody 2551 (IGKV1D-17)
LQHNSYPWT

SEQ ID NO: 5102 - protein, 9 aa, Homo sapiens
  Heavy chain CDR3 for antibody 2551 (IGHV3-33)
AREGAGVDY

SEQ ID NO: 5103 - protein, 9 aa, Homo sapiens
  Light chain CDR3 for antibody 2552 (IGKV3D-20)
QQYGSSPWT

SEQ ID NO: 5104 - protein, 19 aa, Homo sapiens
  Heavy chain CDR3 for antibody 2552 (IGHV1-18)
ARDHGYCSSTSCYRAWFDP

SEQ ID NO: 5105 - protein, 9 aa, Homo sapiens
  Light chain CDR3 for antibody 2553 (IGKV1-9)
HQLNSYPYT

SEQ ID NO: 5106 - protein, 15 aa, Homo sapiens
  Heavy chain CDR3 for antibody 2553 (IGHV1-46)
AREKYHGSGSYPFDY

SEQ ID NO: 5107 - protein, 9 aa, Homo sapiens
  Light chain CDR3 for antibody 2554 (IGKV1-9)
QHLNSHPFT

SEQ ID NO: 5108 - protein, 17 aa, Homo sapiens
  Heavy chain CDR3 for antibody 2554 (IGHV3-33)
AREITMVRGDNYYGMDV

SEQ ID NO: 5109 - protein, 9 aa, Homo sapiens
  Light chain CDR3 for antibody 2555 (IGKV1D-17)
LQHNSYPYT

SEQ ID NO: 5110 - protein, 10 aa, Homo sapiens
  Heavy chain CDR3 for antibody 2555 (IGHV3-33)
ARESGEGFDY

SEQ ID NO: 5111 - protein, 9 aa, Homo sapiens
  Light chain CDR3 for antibody 2556 (IGKV1-12)
QQANSFPWT

SEQ ID NO: 5112 - protein, 19 aa, Homo sapiens
  Heavy chain CDR3 for antibody 2556 (IGHV1-18)
ARDHGYCSSTSCYRAWFDP

SEQ ID NO: 5113 - protein, 9 aa, Homo sapiens
  Light chain CDR3 for antibody 2557 (IGKV1D-17)
LQHNSYPYT

SEQ ID NO: 5114 - protein, 12 aa, Homo sapiens
  Heavy chain CDR3 for antibody 2557 (IGHV4-39)
ARQGSYLNWFDP

SEQ ID NO: 5115 - protein, 9 aa, Homo sapiens
  Light chain CDR3 for antibody 2558 (IGKV1-9)
QQLISYPYT

SEQ ID NO: 5116 - protein, 15 aa, Homo sapiens
  Heavy chain CDR3 for antibody 2558 (IGHV1-46)
AREKYYGSGSYPFDS

SEQ ID NO: 5117 - protein, 9 aa, Homo sapiens
  Light chain CDR3 for antibody 2559 (IGKV1D-17)
LQHNSYPYT

SEQ ID NO: 5118 - protein, 15 aa, Homo sapiens
  Heavy chain CDR3 for antibody 2559 (IGHV1-46)
AREKYYGSGSYPFDY

SEQ ID NO: 5119 - protein, 9 aa, Homo sapiens
  Light chain CDR3 for antibody 2560 (IGKV6-21)
HQSSSLPYT

SEQ ID NO: 5120 - protein, 15 aa, Homo sapiens
  Heavy chain CDR3 for antibody 2560 (IGHV1-46)
AREKYYGSGSYPFDY

SEQ ID NO: 5121 - protein, 9 aa, Homo sapiens
  Light chain CDR3 for antibody 2561 (IGKV1-27)
QKYNSAPLT

SEQ ID NO: 5122 - protein, 13 aa, Homo sapiens
  Heavy chain CDR3 for antibody 2561 (IGHV3-33)
ARDWYYGSGSPYY

SEQ ID NO: 5123 - protein, 9 aa, Homo sapiens
  Light chain CDR3 for antibody 2562 (IGKV1D-17)
LQHNSYPYT

SEQ ID NO: 5124 - protein, 16 aa, Homo sapiens
  Heavy chain CDR3 for antibody 2562 (IGHV1-18)
AREGDTMVRGVIAFDY

SEQ ID NO: 5125 - protein, 9 aa, Homo sapiens
  Light chain CDR3 for antibody 2563 (IGKV2D-30)
MQGTHWPPT

SEQ ID NO: 5126 - protein, 8 aa, Homo sapiens
  Heavy chain CDR3 for antibody 2563 (IGHV4-59)
ARDEGMDV

SEQ ID NO: 5127 - protein, 9 aa, Homo sapiens
  Light chain CDR3 for antibody 2564 (IGKV3-15)
QQYNNWPRT

SEQ ID NO: 5128 - protein, 16 aa, Homo sapiens
  Heavy chain CDR3 for antibody 2564 (IGHV3-33)
ARDRDIVATGEYYFDY

SEQ ID NO: 5129 - protein, 9 aa, Homo sapiens
  Light chain CDR3 for antibody 2565 (IGKV1-5)
QQYNSYSRT

SEQ ID NO: 5130 - protein, 17 aa, Homo sapiens
  Heavy chain CDR3 for antibody 2565 (IGHV4-59)
ARTLFWFGELGGWYFDL

SEQ ID NO: 5131 - protein, 9 aa, Homo sapiens
  Light chain CDR3 for antibody 2566 (IGKV1-27)
HQSSSLPYT

SEQ ID NO: 5132 - protein, 13 aa, Homo sapiens
  Heavy chain CDR3 for antibody 2566 (IGHV1-18)
AREGGSFYVSFDY

SEQ ID NO: 5133 - protein, 9 aa, Homo sapiens
  Light chain CDR3 for antibody 2567 (IGKV1-6)
LQDYNYPYT

SEQ ID NO: 5134 - protein, 14 aa, Homo sapiens
  Heavy chain CDR3 for antibody 2567 (IGHV1-8)
ARGPIVRGVIRFDY

SEQ ID NO: 5135 - protein, 9 aa, Homo sapiens
  Light chain CDR3 for antibody 2568 (IGKV3-15)
QQYNNWPLT

SEQ ID NO: 5136 - protein, 9 aa, Homo sapiens
  Heavy chain CDR3 for antibody 2568 (IGHV4-31)
ARDSGYFDY

SEQ ID NO: 5137 - protein, 9 aa, Homo sapiens
  Light chain CDR3 for antibody 2569 (IGKV1-9)
QQFNSYPFT

SEQ ID NO: 5138 - protein, 17 aa, Homo sapiens
  Heavy chain CDR3 for antibody 2569 (IGHV3-33)
AREITLVRGDNYYGMDV

SEQ ID NO: 5139 - protein, 9 aa, Homo sapiens
  Light chain CDR3 for antibody 2570 (IGKV1-8)
QQYYSYPYT

SEQ ID NO: 5140 - protein, 14 aa, Homo sapiens
  Heavy chain CDR3 for antibody 2570 (IGHV3-23)
AKERAVAGLNWFDP

SEQ ID NO: 5141 - protein, 9 aa, Homo sapiens
  Light chain CDR3 for antibody 2571 (IGKV1-9)
QQLNSYPFT

SEQ ID NO: 5142 - protein, 16 aa, Homo sapiens
  Heavy chain CDR3 for antibody 2571 (IGHV1-18)
AREGDTMVRGVIAFDY

SEQ ID NO: 5143 - protein, 9 aa, Homo sapiens
  Light chain CDR3 for antibody 2572 (IGKV1-9)
HQLISYPYT

SEQ ID NO: 5144 - protein, 15 aa, Homo sapiens
  Heavy chain CDR3 for antibody 2572 (IGHV1-46)
AREKYYGSGSYPFDY

SEQ ID NO: 5145 - protein, 9 aa, Homo sapiens
  Light chain CDR3 for antibody 2573 (IGKV1-9)
QQLNSHPFT

SEQ ID NO: 5146 - protein, 15 aa, Homo sapiens
  Heavy chain CDR3 for antibody 2573 (IGHV1-46)
AREKYYGSGSYPFDY

SEQ ID NO: 5147 - protein, 9 aa, Homo sapiens
  Light chain CDR3 for antibody 2574 (IGKV1-17)
LQHNSYPPT

SEQ ID NO: 5148 - protein, 19 aa, Homo sapiens
  Heavy chain CDR3 for antibody 2574 (IGHV1-18)
ARDHGYCSSTSCYRAWFDP

SEQ ID NO: 5149 - protein, 9 aa, Homo sapiens
  Light chain CDR3 for antibody 2575 (IGKV1-8)
QQYYSYPLT

SEQ ID NO: 5150 - protein, 14 aa, Homo sapiens
  Heavy chain CDR3 for antibody 2575 (IGHV3-23)
AKDRAVAGTYYFDY

SEQ ID NO: 5151 - protein, 9 aa, Homo sapiens
  Light chain CDR3 for antibody 2576 (IGKV6-21)
HQSSSLPYT

SEQ ID NO: 5152 - protein, 10 aa, Homo sapiens
  Heavy chain CDR3 for antibody 2576 (IGHV3-33)
ARESTDGMDV

SEQ ID NO: 5153 - protein, 9 aa, Homo sapiens
  Light chain CDR3 for antibody 2577 (IGKV6-21)
HQSSSLPYT

SEQ ID NO: 5154 - protein, 17 aa, Homo sapiens
  Heavy chain CDR3 for antibody 2577 (IGHV3-33)
AREITMVRGDNYYGMDV

SEQ ID NO: 5155 - protein, 9 aa, Homo sapiens
  Light chain CDR3 for antibody 2578 (IGKV1-9)
HQLNSYPYT

SEQ ID NO: 5156 - protein, 15 aa, Homo sapiens
  Heavy chain CDR3 for antibody 2578 (IGHV1-46)
AREKYHGSGSYPFAS

SEQ ID NO: 5157 - protein, 9 aa, Homo sapiens
  Light chain CDR3 for antibody 2579 (IGKV1-9)
QQLNSYPFT

SEQ ID NO: 5158 - protein, 17 aa, Homo sapiens
  Heavy chain CDR3 for antibody 2579 (IGHV3-33)
VREITMVRGDNYYGLDV

SEQ ID NO: 5159 - protein, 9 aa, Homo sapiens
  Light chain CDR3 for antibody 2580 (IGKV3-20)
QQYGSSPLT

SEQ ID NO: 5160 - protein, 8 aa, Homo sapiens
  Heavy chain CDR3 for antibody 2580 (IGHV4-59)
ASGACFDY

SEQ ID NO: 5161 - protein, 9 aa, Homo sapiens
  Light chain CDR3 for antibody 2581 (IGKV3-20)
QQYGSSPLT

SEQ ID NO: 5162 - protein, 13 aa, Homo sapiens
  Heavy chain CDR3 for antibody 2581 (IGHV1-24)
ATGYSGYEDYFDY

SEQ ID NO: 5163 - protein, 9 aa, Homo sapiens
  Light chain CDR3 for antibody 2582 (IGKV6-21)
HQSSSLPYT

SEQ ID NO: 5164 - protein, 14 aa, Homo sapiens
  Heavy chain CDR3 for antibody 2582 (IGHV1-18)
AREGYSGYLVYFDY

SEQ ID NO: 5165 - protein, 9 aa, Homo sapiens
  Light chain CDR3 for antibody 2583 (IGKV1-9)
QQLNSYPFT

SEQ ID NO: 5166 - protein, 10 aa, Homo sapiens
  Heavy chain CDR3 for antibody 2583 (IGHV3-33)
AREGRTGFDY

SEQ ID NO: 5167 - protein, 9 aa, Homo sapiens
  Light chain CDR3 for antibody 2584 (IGKV1-9)
QHLNSHPFT

SEQ ID NO: 5168 - protein, 10 aa, Homo sapiens
  Heavy chain CDR3 for antibody 2584 (IGHV3-33)
ARESTDGMDA

SEQ ID NO: 5169 - protein, 10 aa, Homo sapiens
  Light chain CDR3 for antibody 2585 (IGKV2D-28)
MQAPQTPPYT

SEQ ID NO: 5170 - protein, 19 aa, Homo sapiens
  Heavy chain CDR3 for antibody 2585 (IGHV1-18)
ARDHGYCSSTSCYRAWFDP

SEQ ID NO: 5171 - protein, 9 aa, Homo sapiens
  Light chain CDR3 for antibody 2586 (IGKV1-9)
QQLNSYPLT

SEQ ID NO: 5172 - protein, 15 aa, Homo sapiens
  Heavy chain CDR3 for antibody 2586 (IGHV1-46)
AREGLTGYYPNWFDP

SEQ ID NO: 5173 - protein, 9 aa, Homo sapiens
  Light chain CDR3 for antibody 2587 (IGKV1D-17)
LQHNSYPYT

SEQ ID NO: 5174 - protein, 10 aa, Homo sapiens
  Heavy chain CDR3 for antibody 2587 (IGHV3-33)
ARESTDGMAA

SEQ ID NO: 5175 - protein, 9 aa, Homo sapiens
  Light chain CDR3 for antibody 2588 (IGKV1-9)
HQLNSYPYT

SEQ ID NO: 5176 - protein, 17 aa, Homo sapiens
  Heavy chain CDR3 for antibody 2588 (IGHV3-33)
AREITMVRGDNYYGLDV

SEQ ID NO: 5177 - protein, 9 aa, Homo sapiens
  Light chain CDR3 for antibody 2589 (IGKV1-9)
QQLNSYPFT

SEQ ID NO: 5178 - protein, 9 aa, Homo sapiens
  Heavy chain CDR3 for antibody 2589 (IGHV3-66)
AREGAGIDY

SEQ ID NO: 5179 - protein, 9 aa, Homo sapiens
  Light chain CDR3 for antibody 2590 (IGKV3-11)
QQRSNWPWT

SEQ ID NO: 5180 - protein, 19 aa, Homo sapiens
  Heavy chain CDR3 for antibody 2590 (IGHV1-18)
ARDHGYCSSTSCYRAWFDP

SEQ ID NO: 5181 - protein, 9 aa, Homo sapiens
  Light chain CDR3 for antibody 2591 (IGKV1-6)
LQDYNYPPT

SEQ ID NO: 5182 - protein, 19 aa, Homo sapiens
  Heavy chain CDR3 for antibody 2591 (IGHV1-2)
ARDHGYCSSTSCYRAWFDP

SEQ ID NO: 5183 - protein, 9 aa, Homo sapiens
  Light chain CDR3 for antibody 2592 (IGKV1-8)
LQDYNYPRT

SEQ ID NO: 5184 - protein, 17 aa, Homo sapiens
  Heavy chain CDR3 for antibody 2592 (IGHV1-18)
AREGIITMVRGVITFDY

SEQ ID NO: 5185 - protein, 9 aa, Homo sapiens
  Light chain CDR3 for antibody 2593 (IGKV1D-17)
LQHNSYPYT

SEQ ID NO: 5186 - protein, 10 aa, Homo sapiens
  Heavy chain CDR3 for antibody 2593 (IGHV3-33)
AREATDGMDA

SEQ ID NO: 5187 - protein, 9 aa, Homo sapiens
  Light chain CDR3 for antibody 2594 (IGKV1D-17)
LQHNSYPYT

SEQ ID NO: 5188 - protein, 10 aa, Homo sapiens
  Heavy chain CDR3 for antibody 2594 (IGHV3-33)
ARESTYAIDV

SEQ ID NO: 5189 - protein, 9 aa, Homo sapiens
  Light chain CDR3 for antibody 2595 (IGKV1D-17)
LQHNSYPYT

SEQ ID NO: 5190 - protein, 10 aa, Homo sapiens
  Heavy chain CDR3 for antibody 2595 (IGHV3-33)
AREATDGFDY

SEQ ID NO: 5191 - protein, 9 aa, Homo sapiens
  Light chain CDR3 for antibody 2596 (IGKV3D-7)
QQDYNLPWT

SEQ ID NO: 5192 - protein, 10 aa, Homo sapiens
  Heavy chain CDR3 for antibody 2596 (IGHV1-18)
ARVTLSGMDV

SEQ ID NO: 5193 - protein, 9 aa, Homo sapiens
  Light chain CDR3 for antibody 2597 (IGKV1-9)
QQFNSYPFT

SEQ ID NO: 5194 - protein, 17 aa, Homo sapiens
  Heavy chain CDR3 for antibody 2597 (IGHV3-33)
AREITVVRGDNYYGMDV

SEQ ID NO: 5195 - protein, 9 aa, Homo sapiens
  Light chain CDR3 for antibody 2598 (IGKV1-9)
QQLNSHPFT

SEQ ID NO: 5196 - protein, 17 aa, Homo sapiens
  Heavy chain CDR3 for antibody 2598 (IGHV3-33)
AREITMVRGDNYYGMEA

SEQ ID NO: 5197 - protein, 9 aa, Homo sapiens
  Light chain CDR3 for antibody 2599 (IGKV1D-16)
QQYNSYPYT

SEQ ID NO: 5198 - protein, 15 aa, Homo sapiens
  Heavy chain CDR3 for antibody 2599 (IGHV4-59)
AQLLWFGDLSGWFDP

SEQ ID NO: 5199 - protein, 9 aa, Homo sapiens
  Light chain CDR3 for antibody 2600 (IGKV1-6)
LQDYNYPYT

SEQ ID NO: 5200 - protein, 16 aa, Homo sapiens
  Heavy chain CDR3 for antibody 2600 (IGHV3-23)
AKDSGSYHYYYYGMDV

SEQ ID NO: 5201 - protein, 9 aa, Homo sapiens
  Light chain CDR3 for antibody 2601 (IGKV1-9)
HQLISYPYT

SEQ ID NO: 5202 - protein, 10 aa, Homo sapiens
  Heavy chain CDR3 for antibody 2601 (IGHV3-33)
ARESTDGMDV

SEQ ID NO: 5203 - protein, 9 aa, Homo sapiens
  Light chain CDR3 for antibody 2602 (IGKV1D-16)
LQDYNYPYT

SEQ ID NO: 5204 - protein, 13 aa, Homo sapiens
  Heavy chain CDR3 for antibody 2602 (IGHV1-24)
ATHYDILTGYFDY

SEQ ID NO: 5205 - protein, 9 aa, Homo sapiens
  Light chain CDR3 for antibody 2603 (IGKV1-9)
QQLNSYPFT

SEQ ID NO: 5206 - protein, 13 aa, Homo sapiens
  Heavy chain CDR3 for antibody 2603 (IGHV1-24)
ATTYSGYAYYFDY

SEQ ID NO: 5207 - protein, 9 aa, Homo sapiens
  Light chain CDR3 for antibody 2604 (IGKV1-17)
LQHNSYPWT

SEQ ID NO: 5208 - protein, 17 aa, Homo sapiens
  Heavy chain CDR3 for antibody 2604 (IGHV1-18)
AREDWNDGYYYYYGMDV

SEQ ID NO: 5209 - protein, 9 aa, Homo sapiens
  Light chain CDR3 for antibody 2605 (IGKV6-21)
HQSSSLPLT

SEQ ID NO: 5210 - protein, 19 aa, Homo sapiens
  Heavy chain CDR3 for antibody 2605 (IGHV3-33)
AREDSSSWYPDYYYYGMDV

SEQ ID NO: 5211 - protein, 9 aa, Homo sapiens
  Light chain CDR3 for antibody 2606 (IGKV1-9)
QQFNSYPFT

SEQ ID NO: 5212 - protein, 17 aa, Homo sapiens
  Heavy chain CDR3 for antibody 2606 (IGHV3-33)
GREITMVRGDNYYGMDV

SEQ ID NO: 5213 - protein, 9 aa, Homo sapiens
  Light chain CDR3 for antibody 2607 (IGKV1-9)
QQLNSHPFT

SEQ ID NO: 5214 - protein, 17 aa, Homo sapiens
  Heavy chain CDR3 for antibody 2607 (IGHV3-33)
AREITMVRGDTSYGMDV

SEQ ID NO: 5215 - protein, 9 aa, Homo sapiens
  Light chain CDR3 for antibody 2608 (IGKV1-8)
QQYYSYPLT

SEQ ID NO: 5216 - protein, 16 aa, Homo sapiens
  Heavy chain CDR3 for antibody 2608 (IGHV3-33)
ARDRDIVAKGEYYFDY

SEQ ID NO: 5217 - protein, 9 aa, Homo sapiens
  Light chain CDR3 for antibody 2609 (IGKV1-9)
QQLNSYPFT

SEQ ID NO: 5218 - protein, 10 aa, Homo sapiens
  Heavy chain CDR3 for antibody 2609 (IGHV3-33)
ARESGEGFDY

SEQ ID NO: 5219 - protein, 9 aa, Homo sapiens
  Light chain CDR3 for antibody 2610 (IGKV1-27)
QKYNSAPYT

SEQ ID NO: 5220 - protein, 13 aa, Homo sapiens
  Heavy chain CDR3 for antibody 2610 (IGHV3-33)
ARVLRYFDPDFDY

SEQ ID NO: 5221 - protein, 9 aa, Homo sapiens
  Light chain CDR3 for antibody 2611 (IGKV1-6)
LQDYNYPFT

SEQ ID NO: 5222 - protein, 10 aa, Homo sapiens
  Heavy chain CDR3 for antibody 2611 (IGHV3-33)
ARGVWFGADY

SEQ ID NO: 5223 - protein, 9 aa, Homo sapiens
  Light chain CDR3 for antibody 2612 (IGKV1-9)
HQLNSYPYT

SEQ ID NO: 5224 - protein, 15 aa, Homo sapiens
  Heavy chain CDR3 for antibody 2612 (IGHV1-46)
AREKYHGSGTYPIDY

SEQ ID NO: 5225 - protein, 9 aa, Homo sapiens
  Light chain CDR3 for antibody 2613 (IGKV1-9)
QQLNGYPYT

SEQ ID NO: 5226 - protein, 15 aa, Homo sapiens
  Heavy chain CDR3 for antibody 2613 (IGHV1-46)
AREKSYGSGSYPIDY

SEQ ID NO: 5227 - protein, 9 aa, Homo sapiens
  Light chain CDR3 for antibody 2614 (IGKV1-8)
QQYYSYPFT

SEQ ID NO: 5228 - protein, 14 aa, Homo sapiens
  Heavy chain CDR3 for antibody 2614 (IGHV3-23)
AKAIAVAGTWYFDL

SEQ ID NO: 5229 - protein, 8 aa, Homo sapiens
  Light chain CDR3 for antibody 2615 (IGKV1D-13)
QQFNNYPT

SEQ ID NO: 5230 - protein, 18 aa, Homo sapiens
  Heavy chain CDR3 for antibody 2615 (IGHV3-11)
ARDRGIAAAGTYYYGMDV

SEQ ID NO: 5231 - protein, 9 aa, Homo sapiens
  Light chain CDR3 for antibody 2616 (IGKV6-21)
HQSSSLPHT

SEQ ID NO: 5232 - protein, 17 aa, Homo sapiens
  Heavy chain CDR3 for antibody 2616 (IGHV1-18)
AREGAWFGELLSYYFDY

SEQ ID NO: 5233 - protein, 9 aa, Homo sapiens
  Light chain CDR3 for antibody 2617 (IGKV1-27)
QKYNSAPLT

SEQ ID NO: 5234 - protein, 17 aa, Homo sapiens
  Heavy chain CDR3 for antibody 2617 (IGHV3-33)
AREITMVRGDNYYGMDV

SEQ ID NO: 5235 - protein, 9 aa, Homo sapiens
  Light chain CDR3 for antibody 2618 (IGKV1-9)
QQFNSHPFT

SEQ ID NO: 5236 - protein, 17 aa, Homo sapiens
  Heavy chain CDR3 for antibody 2618 (IGHV3-33)
AREITMVRGDNYYGMDV

SEQ ID NO: 5237 - protein, 9 aa, Homo sapiens
  Light chain CDR3 for antibody 2619 (IGKV1-9)
QQFNSYPFT

SEQ ID NO: 5238 - protein, 17 aa, Homo sapiens
  Heavy chain CDR3 for antibody 2619 (IGHV3-30)
AREITMVRGDNYYALDV

SEQ ID NO: 5239 - protein, 9 aa, Homo sapiens
  Light chain CDR3 for antibody 2620 (IGKV1-9)
HQLNSYPYT

SEQ ID NO: 5240 - protein, 16 aa, Homo sapiens
  Heavy chain CDR3 for antibody 2620 (IGHV1-18)
AREGETMVRGVIAFDY

SEQ ID NO: 5241 - protein, 9 aa, Homo sapiens
  Light chain CDR3 for antibody 2621 (IGKV1D-17)
LQHNSYPYT

SEQ ID NO: 5242 - protein, 17 aa, Homo sapiens
  Heavy chain CDR3 for antibody 2621 (IGHV3-33)
AREVTMVRGDNYYGLDV

SEQ ID NO: 5243 - protein, 9 aa, Homo sapiens
  Light chain CDR3 for antibody 2622 (IGKV3-15)
QQYNNWPRT

SEQ ID NO: 5244 - protein, 17 aa, Homo sapiens
  Heavy chain CDR3 for antibody 2622 (IGHV3-33)
AREITMVRGDNYYGMDV

SEQ ID NO: 5245 - protein, 9 aa, Homo sapiens
  Light chain CDR3 for antibody 2623 (IGKV1D-17)
LQHNSYPYT

SEQ ID NO: 5246 - protein, 10 aa, Homo sapiens
  Heavy chain CDR3 for antibody 2623 (IGHV3-33)
AGDATDGMDV

SEQ ID NO: 5247 - protein, 9 aa, Homo sapiens
  Light chain CDR3 for antibody 2624 (IGKV1-9)
QQLNSYPFT

SEQ ID NO: 5248 - protein, 13 aa, Homo sapiens
  Heavy chain CDR3 for antibody 2624 (IGHV3-33)
ARDWYYGSGSPYY

SEQ ID NO: 5249 - protein, 9 aa, Homo sapiens
  Light chain CDR3 for antibody 2625 (IGKV1-9)
QHLNSHPFT

SEQ ID NO: 5250 - protein, 17 aa, Homo sapiens
  Heavy chain CDR3 for antibody 2625 (IGHV3-33)
ARESTMVRGDNYYGMDV

SEQ ID NO: 5251 - protein, 9 aa, Homo sapiens
  Light chain CDR3 for antibody 2626 (IGKV1-9)
QQLISYPYT

SEQ ID NO: 5252 - protein, 15 aa, Homo sapiens
  Heavy chain CDR3 for antibody 2626 (IGHV1-46)
AREKYYGSGSYPIAS

SEQ ID NO: 5253 - protein, 9 aa, Homo sapiens
  Light chain CDR3 for antibody 2627 (IGKV1-9)
QQLNSYPYT

SEQ ID NO: 5254 - protein, 19 aa, Homo sapiens
  Heavy chain CDR3 for antibody 2627 (IGHV3-33)
AREDSSSWYPDYYYYGMDV

SEQ ID NO: 5255 - protein, 9 aa, Homo sapiens
  Light chain CDR3 for antibody 2628 (IGKV1-8)
QQANSFPWT

SEQ ID NO: 5256 - protein, 14 aa, Homo sapiens
  Heavy chain CDR3 for antibody 2628 (IGHV3-23)
AKNDILTGLRYFDL

SEQ ID NO: 5257 - protein, 9 aa, Homo sapiens
  Light chain CDR3 for antibody 2629 (IGKV1-9)
QQLNSYPFT

SEQ ID NO: 5258 - protein, 17 aa, Homo sapiens
  Heavy chain CDR3 for antibody 2629 (IGHV3-33)
AREIARVRGDNYYGLDV

SEQ ID NO: 5259 - protein, 9 aa, Homo sapiens
  Light chain CDR3 for antibody 2630 (IGKV1D-17)
QQLNGYPYT

SEQ ID NO: 5260 - protein, 15 aa, Homo sapiens
  Heavy chain CDR3 for antibody 2630 (IGHV1-46)
AREKYYGSGSYPFAS

SEQ ID NO: 5261 - protein, 9 aa, Homo sapiens
  Light chain CDR3 for antibody 2631 (IGKV3D-20)
QQYGSSPWT

SEQ ID NO: 5262 - protein, 15 aa, Homo sapiens
  Heavy chain CDR3 for antibody 2631 (IGHV1-46)
AREKYYGSGSYPFDY

SEQ ID NO: 5263 - protein, 9 aa, Homo sapiens
  Light chain CDR3 for antibody 2632 (IGKV1D-17)
LQHNSYPYT

SEQ ID NO: 5264 - protein, 10 aa, Homo sapiens
  Heavy chain CDR3 for antibody 2632 (IGHV3-33)
ASEATDGMEV

SEQ ID NO: 5265 - protein, 9 aa, Homo sapiens
  Light chain CDR3 for antibody 2633 (IGKV1-6)
LQDYNYPWT

SEQ ID NO: 5266 - protein, 13 aa, Homo sapiens
  Heavy chain CDR3 for antibody 2633 (IGHV1-24)
ATTYSGYAYYFDY

SEQ ID NO: 5267 - protein, 9 aa, Homo sapiens
  Light chain CDR3 for antibody 2634 (IGKV1-6)
LQDYNYPWT

SEQ ID NO: 5268 - protein, 17 aa, Homo sapiens
  Heavy chain CDR3 for antibody 2634 (IGHV1-46)
ARVYGDYGGYYYYGMDV

SEQ ID NO: 5269 - protein, 9 aa, Homo sapiens
  Light chain CDR3 for antibody 2635 (IGKV1-9)
QQFNSHPFT

SEQ ID NO: 5270 - protein, 10 aa, Homo sapiens
  Heavy chain CDR3 for antibody 2635 (IGHV3-33)
ARESVAGFDY

SEQ ID NO: 5271 - protein, 9 aa, Homo sapiens
  Light chain CDR3 for antibody 2636 (IGKV1-16)
QQYNSYPYT

SEQ ID NO: 5272 - protein, 16 aa, Homo sapiens
  Heavy chain CDR3 for antibody 2636 (IGHV3-33)
ARDFLAVAGTWNWFDP

SEQ ID NO: 5273 - protein, 9 aa, Homo sapiens
  Light chain CDR3 for antibody 2637 (IGKV1D-17)
LQHNSYPYT

SEQ ID NO: 5274 - protein, 15 aa, Homo sapiens
  Heavy chain CDR3 for antibody 2637 (IGHV1-46)
AREKYHGSGSYPFDY

SEQ ID NO: 5275 - protein, 9 aa, Homo sapiens
  Light chain CDR3 for antibody 2638 (IGKV1-9)
QQLNSYPYT

SEQ ID NO: 5276 - protein, 15 aa, Homo sapiens
  Heavy chain CDR3 for antibody 2638 (IGHV1-46)
AREKSYGSGSSPFAY

SEQ ID NO: 5277 - protein, 9 aa, Homo sapiens
  Light chain CDR3 for antibody 2639 (IGKV3D-20)
QQYGSSPWT

SEQ ID NO: 5278 - protein, 16 aa, Homo sapiens
  Heavy chain CDR3 for antibody 2639 (IGHV1-18)
AREGDTMVRGVIAFDY

SEQ ID NO: 5279 - protein, 9 aa, Homo sapiens
  Light chain CDR3 for antibody 2640 (IGKV1-6)
LQYYSYPFT

SEQ ID NO: 5280 - protein, 12 aa, Homo sapiens
  Heavy chain CDR3 for antibody 2640 (IGHV4-39)
ARQGSYLSWFDP

SEQ ID NO: 5281 - protein, 9 aa, Homo sapiens
  Light chain CDR3 for antibody 2641 (IGKV1-8)
QQYYSYPLT

SEQ ID NO: 5282 - protein, 17 aa, Homo sapiens
  Heavy chain CDR3 for antibody 2641 (IGHV3-33)
AREITMVRGDNYYGMDV

SEQ ID NO: 5283 - protein, 9 aa, Homo sapiens
  Light chain CDR3 for antibody 2642 (IGKV1D-17)
LQHNSYPYT

SEQ ID NO: 5284 - protein, 17 aa, Homo sapiens
  Heavy chain CDR3 for antibody 2642 (IGHV3-33)
VREITMVRGDNYYGLDV

SEQ ID NO: 5285 - protein, 9 aa, Homo sapiens
  Light chain CDR3 for antibody 2643 (IGKV1-9)
HQLNSYPYT

SEQ ID NO: 5286 - protein, 10 aa, Homo sapiens
  Heavy chain CDR3 for antibody 2643 (IGHV3-33)
AREAVAGFDY

SEQ ID NO: 5287 - protein, 9 aa, Homo sapiens
  Light chain CDR3 for antibody 2644 (IGKV1D-17)
LQHNSYPYT

SEQ ID NO: 5288 - protein, 10 aa, Homo sapiens
  Heavy chain CDR3 for antibody 2644 (IGHV3-33)
ARDSTAGMDA

SEQ ID NO: 5289 - protein, 9 aa, Homo sapiens
  Light chain CDR3 for antibody 2645 (IGKV1D-17)
LQHNSYPYT

SEQ ID NO: 5290 - protein, 10 aa, Homo sapiens
  Heavy chain CDR3 for antibody 2645 (IGHV3-33)
AREATAGIDV

SEQ ID NO: 5291 - protein, 9 aa, Homo sapiens
  Light chain CDR3 for antibody 2646 (IGKV1D-16)
QQYNSYPLT

SEQ ID NO: 5292 - protein, 16 aa, Homo sapiens
  Heavy chain CDR3 for antibody 2646 (IGHV3-23)
AKEYYYGSGSYSLFDY

SEQ ID NO: 5293 - protein, 9 aa, Homo sapiens
  Light chain CDR3 for antibody 2647 (IGKV6-21)
HQSSSLPQT

SEQ ID NO: 5294 - protein, 17 aa, Homo sapiens
  Heavy chain CDR3 for antibody 2647 (IGHV4-39)
ASQRGYSGYDPYWYFDL

SEQ ID NO: 5295 - protein, 9 aa, Homo sapiens
  Light chain CDR3 for antibody 2648 (IGKV1-9)
QQLNSHPFT

SEQ ID NO: 5296 - protein, 17 aa, Homo sapiens
  Heavy chain CDR3 for antibody 2648 (IGHV3-33)
AREINMGRGDNYYGMDV

SEQ ID NO: 5297 - protein, 9 aa, Homo sapiens
  Light chain CDR3 for antibody 2649 (IGKV1-17)
LQHNSYPWT

SEQ ID NO: 5298 - protein, 19 aa, Homo sapiens
  Heavy chain CDR3 for antibody 2649 (IGHV3-11)
AREDSSSWYPDYYYYGMDV

SEQ ID NO: 5299 - protein, 9 aa, Homo sapiens
  Light chain CDR3 for antibody 2650 (IGKV3-11)
QQRSNWPWT

SEQ ID NO: 5300 - protein, 14 aa, Homo sapiens
  Heavy chain CDR3 for antibody 2650 (IGHV3-13)
ARENYYGSGSYFDY

SEQ ID NO: 5301 - protein, 9 aa, Homo sapiens
  Light chain CDR3 for antibody 2651 (IGKV1D-16)
LQDYNYPYT

SEQ ID NO: 5302 - protein, 17 aa, Homo sapiens
  Heavy chain CDR3 for antibody 2651 (IGHV3-33)
AREITMVRGDNYYGMDV

SEQ ID NO: 5303 - protein, 9 aa, Homo sapiens
  Light chain CDR3 for antibody 2652 (IGKV1-6)
LQDYNYPWT

SEQ ID NO: 5304 - protein, 18 aa, Homo sapiens
  Heavy chain CDR3 for antibody 2652 (IGHV3-33)
ARYGDPERDYYYYYGMDV

SEQ ID NO: 5305 - protein, 9 aa, Homo sapiens
  Light chain CDR3 for antibody 2653 (IGKV1-17)
LQHNSYPLT

SEQ ID NO: 5306 - protein, 16 aa, Homo sapiens
  Heavy chain CDR3 for antibody 2653 (IGHV3-23)
AKDSGSYHYYYYGMDV

SEQ ID NO: 5307 - protein, 9 aa, Homo sapiens
  Light chain CDR3 for antibody 2654 (IGKV1D-16)
QQYGSSPRT

SEQ ID NO: 5308 - protein, 15 aa, Homo sapiens
  Heavy chain CDR3 for antibody 2654 (IGHV1-18)
ASYSGSYYYYYGMDV

SEQ ID NO: 5309 - protein, 9 aa, Homo sapiens
  Light chain CDR3 for antibody 2655 (IGKV1-9)
QHLNSHPFT

SEQ ID NO: 5310 - protein, 17 aa, Homo sapiens
  Heavy chain CDR3 for antibody 2655 (IGHV3-33)
AREITMVRGDNYYGMAV

SEQ ID NO: 5311 - protein, 9 aa, Homo sapiens
  Light chain CDR3 for antibody 2656 (IGKV1-6)
LQDYNYPLT

SEQ ID NO: 5312 - protein, 9 aa, Homo sapiens
  Heavy chain CDR3 for antibody 2656 (IGHV3-66)
AREGDYIDY

SEQ ID NO: 5313 - protein, 9 aa, Homo sapiens
  Light chain CDR3 for antibody 2657 (IGKV3D-20)
QQANSFPWT

SEQ ID NO: 5314 - protein, 15 aa, Homo sapiens
  Heavy chain CDR3 for antibody 2657 (IGHV1-46)
AREKYYGSGSYPFDY

SEQ ID NO: 5315 - protein, 7 aa, Homo sapiens
  Light chain CDR3 for antibody 2658 (IGKV1D-13)
QQFNNYT

SEQ ID NO: 5316 - protein, 14 aa, Homo sapiens
  Heavy chain CDR3 for antibody 2658 (IGHV3-33)
ARETMVRGVRGFDP

SEQ ID NO: 5317 - protein, 9 aa, Homo sapiens
  Light chain CDR3 for antibody 2659 (IGKV1-9)
QQLNSYPFT

SEQ ID NO: 5318 - protein, 17 aa, Homo sapiens
  Heavy chain CDR3 for antibody 2659 (IGHV3-33)
AREITMVRGDNSYGLDV

SEQ ID NO: 5319 - protein, 9 aa, Homo sapiens
  Light chain CDR3 for antibody 2660 (IGKV1-9)
QQLNSYPFT

SEQ ID NO: 5320 - protein, 15 aa, Homo sapiens
  Heavy chain CDR3 for antibody 2660 (IGHV1-46)
AREKYYGSGSYPFDS

SEQ ID NO: 5321 - protein, 9 aa, Homo sapiens
  Light chain CDR3 for antibody 2661 (IGKV6-21)
HQSSSLPYT

SEQ ID NO: 5322 - protein, 10 aa, Homo sapiens
  Heavy chain CDR3 for antibody 2661 (IGHV1-18)
AREAVAGFDY

SEQ ID NO: 5323 - protein, 9 aa, Homo sapiens
  Light chain CDR3 for antibody 2662 (IGKV1-8)
QQYYSYPYT

SEQ ID NO: 5324 - protein, 10 aa, Homo sapiens
  Heavy chain CDR3 for antibody 2662 (IGHV3-33)
ARESTDGMDV

SEQ ID NO: 5325 - protein, 9 aa, Homo sapiens
  Light chain CDR3 for antibody 2663 (IGKV1-12)
QQANSFPWT

SEQ ID NO: 5326 - protein, 13 aa, Homo sapiens
  Heavy chain CDR3 for antibody 2663 (IGHV1-24)
ATTYSGYAYYFDY

SEQ ID NO: 5327 - protein, 9 aa, Homo sapiens
  Light chain CDR3 for antibody 2664 (IGKV1-9)
QQLNSYPFT

SEQ ID NO: 5328 - protein, 17 aa, Homo sapiens
  Heavy chain CDR3 for antibody 2664 (IGHV3-33)
AREITMGRGDNYYGLDV

SEQ ID NO: 5329 - protein, 9 aa, Homo sapiens
  Light chain CDR3 for antibody 2665 (IGKV6-21)
HQSSSLPYT

SEQ ID NO: 5330 - protein, 19 aa, Homo sapiens
  Heavy chain CDR3 for antibody 2665 (IGHV1-18)
ARDHGYCSSTSCYRAWFDP

SEQ ID NO: 5331 - protein, 9 aa, Homo sapiens
  Light chain CDR3 for antibody 2666 (IGKV1-6)
LQDYNYPYT

SEQ ID NO: 5332 - protein, 15 aa, Homo sapiens
  Heavy chain CDR3 for antibody 2666 (IGHV4-39)
ASRESGYSSGWYEDY

SEQ ID NO: 5333 - protein, 9 aa, Homo sapiens
  Light chain CDR3 for antibody 2667 (IGKV1-9)
QQLNSYPFT

SEQ ID NO: 5334 - protein, 15 aa, Homo sapiens
  Heavy chain CDR3 for antibody 2667 (IGHV1-46)
AREKYHGSGSYPFEY

SEQ ID NO: 5335 - protein, 9 aa, Homo sapiens
  Light chain CDR3 for antibody 2668 (IGKV6-21)
HQSSSLPYT

SEQ ID NO: 5336 - protein, 13 aa, Homo sapiens
  Heavy chain CDR3 for antibody 2668 (IGHV1-24)
ATHYDILTGYFDY

SEQ ID NO: 5337 - protein, 9 aa, Homo sapiens
  Light chain CDR3 for antibody 2669 (IGKV5-2)
LQHDNFPYT

SEQ ID NO: 5338 - protein, 9 aa, Homo sapiens
  Heavy chain CDR3 for antibody 2669 (IGHV3-33)
AREGAGVDY

SEQ ID NO: 5339 - protein, 9 aa, Homo sapiens
  Light chain CDR3 for antibody 2670 (IGKV1-27)
QKYNSAPLT

SEQ ID NO: 5340 - protein, 10 aa, Homo sapiens
  Heavy chain CDR3 for antibody 2670 (IGHV3-33)
ARESTDGMDV

SEQ ID NO: 5341 - protein, 9 aa, Homo sapiens
  Light chain CDR3 for antibody 2671 (IGKV1-9)
QQFNSHPFT

SEQ ID NO: 5342 - protein, 10 aa, Homo sapiens
  Heavy chain CDR3 for antibody 2671 (IGHV3-33)
ARESTDGMDV

SEQ ID NO: 5343 - protein, 9 aa, Homo sapiens
  Light chain CDR3 for antibody 2672 (IGKV1-9)
QQLDSYPFI

SEQ ID NO: 5344 - protein, 17 aa, Homo sapiens
  Heavy chain CDR3 for antibody 2672 (IGHV3-33)
AREITMVRGDNYYGLDV

SEQ ID NO: 5345 - protein, 9 aa, Homo sapiens
  Light chain CDR3 for antibody 2673 (IGKV1-17)
QQLNSYPYT

SEQ ID NO: 5346 - protein, 13 aa, Homo sapiens
  Heavy chain CDR3 for antibody 2673 (IGHV1-24)
ATDYGDYRYYFDY

SEQ ID NO: 5347 - protein, 9 aa, Homo sapiens
  Light chain CDR3 for antibody 2674 (IGKV1-9)
QQFNSHPFT

SEQ ID NO: 5348 - protein, 15 aa, Homo sapiens
  Heavy chain CDR3 for antibody 2674 (IGHV1-46)
AREKYHGSGSYPFDY

SEQ ID NO: 5349 - protein, 9 aa, Homo sapiens
  Light chain CDR3 for antibody 2675 (IGKV1-39)
QQSYSTPYT

SEQ ID NO: 5350 - protein, 13 aa, Homo sapiens
  Heavy chain CDR3 for antibody 2675 (IGHV1-24)
ATDYGDYRYYFDY

SEQ ID NO: 5351 - protein, 9 aa, Homo sapiens
  Light chain CDR3 for antibody 2676 (IGKV1D-16)
QQYNSYPYT

SEQ ID NO: 5352 - protein, 17 aa, Homo sapiens
  Heavy chain CDR3 for antibody 2676 (IGHV3-33)
ARDRATVTLYYYYGMDV

SEQ ID NO: 5353 - protein, 9 aa, Homo sapiens
  Light chain CDR3 for antibody 2677 (IGKV1-17)
LQHNSYPYT

SEQ ID NO: 5354 - protein, 11 aa, Homo sapiens
  Heavy chain CDR3 for antibody 2677 (IGHV3-11)
AREGPNWDFDY

SEQ ID NO: 5355 - protein, 9 aa, Homo sapiens
  Light chain CDR3 for antibody 2678 (IGKV1-9)
QQLNSYPFT

SEQ ID NO: 5356 - protein, 17 aa, Homo sapiens
  Heavy chain CDR3 for antibody 2678 (IGHV3-33)
VRESTMVRGENYYGLDV

SEQ ID NO: 5357 - protein, 9 aa, Homo sapiens
  Light chain CDR3 for antibody 2679 (IGKV1-9)
QQLNSHPFT

SEQ ID NO: 5358 - protein, 17 aa, Homo sapiens
  Heavy chain CDR3 for antibody 2679 (IGHV3-33)
AREITMFRGDNYYGMDV

SEQ ID NO: 5359 - protein, 9 aa, Homo sapiens
  Light chain CDR3 for antibody 2680 (IGKV1-9)
QHLNSHPFT

SEQ ID NO: 5360 - protein, 10 aa, Homo sapiens
  Heavy chain CDR3 for antibody 2680 (IGHV3-33)
AREAVAGFDY

SEQ ID NO: 5361 - protein, 9 aa, Homo sapiens
  Light chain CDR3 for antibody 2681 (IGKV1D-17)
LQHNSYPYT

SEQ ID NO: 5362 - protein, 10 aa, Homo sapiens
  Heavy chain CDR3 for antibody 2681 (IGHV3-33)
ARESTDGMEA

SEQ ID NO: 5363 - protein, 9 aa, Homo sapiens
  Light chain CDR3 for antibody 2682 (IGKV1D-16)
QQYNSYPYT

SEQ ID NO: 5364 - protein, 14 aa, Homo sapiens
  Heavy chain CDR3 for antibody 2682 (IGHV3-33)
ARENIAVVQGGMDV

SEQ ID NO: 5365 - protein, 9 aa, Homo sapiens
  Light chain CDR3 for antibody 2683 (IGKV3D-20)
QQYGSSPWT

SEQ ID NO: 5366 - protein, 10 aa, Homo sapiens
  Heavy chain CDR3 for antibody 2683 (IGHV3-33)
ARESTDGMDV

SEQ ID NO: 5367 - protein, 9 aa, Homo sapiens
  Light chain CDR3 for antibody 2684 (IGKV3-15)
QQYNNWPRT

SEQ ID NO: 5368 - protein, 10 aa, Homo sapiens
  Heavy chain CDR3 for antibody 2684 (IGHV3-33)
ARESTDGMDV

SEQ ID NO: 5369 - protein, 9 aa, Homo sapiens
  Light chain CDR3 for antibody 2685 (IGKV1-9)
QQLISYPYT

SEQ ID NO: 5370 - protein, 15 aa, Homo sapiens
  Heavy chain CDR3 for antibody 2685 (IGHV1-46)
AREKYYGSGSYPFDA

SEQ ID NO: 5371 - protein, 9 aa, Homo sapiens
  Light chain CDR3 for antibody 2686 (IGKV6-21)
HQSSSLPWT

SEQ ID NO: 5372 - protein, 13 aa, Homo sapiens
  Heavy chain CDR3 for antibody 2686 (IGHV1-24)
ATGYSGYEDYFDY

SEQ ID NO: 5373 - protein, 9 aa, Homo sapiens
  Light chain CDR3 for antibody 2687 (IGKV3D-20)
QQYGSSPWT

SEQ ID NO: 5374 - protein, 17 aa, Homo sapiens
  Heavy chain CDR3 for antibody 2687 (IGHV3-33)
AREITMVRGDNYYGMDV

SEQ ID NO: 5375 - protein, 9 aa, Homo sapiens
  Light chain CDR3 for antibody 2688 (IGKV1D-17)
LQHNSYPYT

SEQ ID NO: 5376 - protein, 10 aa, Homo sapiens
  Heavy chain CDR3 for antibody 2688 (IGHV3-33)
ASASTAGMDV

SEQ ID NO: 5377 - protein, 9 aa, Homo sapiens
  Light chain CDR3 for antibody 2689 (IGKV1-12)
QQANSFPWT

SEQ ID NO: 5378 - protein, 17 aa, Homo sapiens
  Heavy chain CDR3 for antibody 2689 (IGHV3-33)
AREITMVRGDNYYGMDV

SEQ ID NO: 5379 - protein, 9 aa, Homo sapiens
  Light chain CDR3 for antibody 2690 (IGKV1-9)
QQLNSHPFT

SEQ ID NO: 5380 - protein, 17 aa, Homo sapiens
  Heavy chain CDR3 for antibody 2690 (IGHV3-33)
ARESTMVRGENYYGMDV

SEQ ID NO: 5381 - protein, 8 aa, Homo sapiens
  Light chain CDR3 for antibody 2691 (IGKV1D-13)
QQFNNYPT

SEQ ID NO: 5382 - protein, 15 aa, Homo sapiens
  Heavy chain CDR3 for antibody 2691 (IGHV3-33)
ARKGYSSGWYGLADV

SEQ ID NO: 5383 - protein, 9 aa, Homo sapiens
  Light chain CDR3 for antibody 2692 (IGKV1-9)
QQLISYPYT

SEQ ID NO: 5384 - protein, 17 aa, Homo sapiens
  Heavy chain CDR3 for antibody 2692 (IGHV1-46)
AREITLVRGDNYYGMDV

SEQ ID NO: 5385 - protein, 9 aa, Homo sapiens
  Light chain CDR3 for antibody 2693 (IGKV1-9)
QQLNSYPWT

SEQ ID NO: 5386 - protein, 15 aa, Homo sapiens
  Heavy chain CDR3 for antibody 2693 (IGHV3-33)
ARGHYDISYWYGMDV

SEQ ID NO: 5387 - protein, 9 aa, Homo sapiens
  Light chain CDR3 for antibody 2694 (IGKV1-9)
QQFNSHPFT

SEQ ID NO: 5388 - protein, 17 aa, Homo sapiens
  Heavy chain CDR3 for antibody 2694 (IGHV3-33)
EREITMVRGDNYYGLDV

SEQ ID NO: 5389 - protein, 9 aa, Homo sapiens
  Light chain CDR3 for antibody 2695 (IGKV1-9)
QQLNSHPFT

SEQ ID NO: 5390 - protein, 15 aa, Homo sapiens
  Heavy chain CDR3 for antibody 2695 (IGHV3-33)
AREITMVRGVIAFDY

SEQ ID NO: 5391 - protein, 9 aa, Homo sapiens
  Light chain CDR3 for antibody 2696 (IGKV1D-17)
LQHNSYPYT

SEQ ID NO: 5392 - protein, 10 aa, Homo sapiens
  Heavy chain CDR3 for antibody 2696 (IGHV3-33)
AIESPDGMDA

SEQ ID NO: 5393 - protein, 9 aa, Homo sapiens
  Light chain CDR3 for antibody 2697 (IGKV1-9)
QQLNSYPFT

SEQ ID NO: 5394 - protein, 16 aa, Homo sapiens
  Heavy chain CDR3 for antibody 2697 (IGHV3-33)
ARGGSYLVYYYYGMDV

SEQ ID NO: 5395 - protein, 9 aa, Homo sapiens
  Light chain CDR3 for antibody 2698 (IGKV1-6)
LQDYNYPYT

SEQ ID NO: 5396 - protein, 15 aa, Homo sapiens
  Heavy chain CDR3 for antibody 2698 (IGHV3-33)
AREGDIVATYAGMDV

SEQ ID NO: 5397 - protein, 9 aa, Homo sapiens
  Light chain CDR3 for antibody 2699 (IGKV1D-17)
LQHNSYPYT

SEQ ID NO: 5398 - protein, 10 aa, Homo sapiens
  Heavy chain CDR3 for antibody 2699 (IGHV3-33)
AIESTDAMDV

SEQ ID NO: 5399 - protein, 9 aa, Homo sapiens
  Light chain CDR3 for antibody 2700 (IGKV3-11)
QQRSNWPWT

SEQ ID NO: 5400 - protein, 27 aa, Homo sapiens
  Heavy chain CDR3 for antibody 2700 (IGHV3-53)
ARDRHIVVVTADIREDSYYYYYYGMDV

SEQ ID NO: 5401 - protein, 9 aa, Homo sapiens
  Light chain CDR3 for antibody 2701 (IGKV1-9)
QQLNSYPFT

SEQ ID NO: 5402 - protein, 17 aa, Homo sapiens
  Heavy chain CDR3 for antibody 2701 (IGHV3-30)
AREITMIRGDNYYAIDV

SEQ ID NO: 5403 - protein, 9 aa, Homo sapiens
  Light chain CDR3 for antibody 2702 (IGKV1-9)
QQLNSYPFT

SEQ ID NO: 5404 - protein, 17 aa, Homo sapiens
  Heavy chain CDR3 for antibody 2702 (IGHV3-33)
AREITMGRGDNYDGMDV

SEQ ID NO: 5405 - protein, 9 aa, Homo sapiens
  Light chain CDR3 for antibody 2703 (IGKV1-9)
HQLNSYPYT

SEQ ID NO: 5406 - protein, 15 aa, Homo sapiens
  Heavy chain CDR3 for antibody 2703 (IGHV1-46)
AREKYHGAGSYPFDY

SEQ ID NO: 5407 - protein, 9 aa, Homo sapiens
  Light chain CDR3 for antibody 2704 (IGKV1-9)
QQLNGYPYT

SEQ ID NO: 5408 - protein, 17 aa, Homo sapiens
  Heavy chain CDR3 for antibody 2704 (IGHV3-33)
AREVTMVRGDNYYGLDV

SEQ ID NO: 5409 - protein, 9 aa, Homo sapiens
  Light chain CDR3 for antibody 2705 (IGKV1-6)
LQDYNYPYT

SEQ ID NO: 5410 - protein, 15 aa, Homo sapiens
  Heavy chain CDR3 for antibody 2705 (IGHV1-46)
AREKYYGSGSYPFDY

SEQ ID NO: 5411 - protein, 9 aa, Homo sapiens
  Light chain CDR3 for antibody 2706 (IGKV3-11)
QQRSNWPPT

SEQ ID NO: 5412 - protein, 13 aa, Homo sapiens
  Heavy chain CDR3 for antibody 2706 (IGHV3-23)
AKECIAAAGPLDY

SEQ ID NO: 5413 - protein, 9 aa, Homo sapiens
  Light chain CDR3 for antibody 2707 (IGKV1-9)
QQLNSYPFT

SEQ ID NO: 5414 - protein, 17 aa, Homo sapiens
  Heavy chain CDR3 for antibody 2707 (IGHV3-33)
ARESTMARGDNYYGMAV

SEQ ID NO: 5415 - protein, 9 aa, Homo sapiens
  Light chain CDR3 for antibody 2708 (IGKV3D-11)
QQRSNWQYT

SEQ ID NO: 5416 - protein, 19 aa, Homo sapiens
  Heavy chain CDR3 for antibody 2708 (IGHV1-18)
ARDHGYCSSTSRYRAWFDP

SEQ ID NO: 5417 - protein, 9 aa, Homo sapiens
  Light chain CDR3 for antibody 2709 (IGKV1D-17)
LQHNSYPYT

SEQ ID NO: 5418 - protein, 14 aa, Homo sapiens
  Heavy chain CDR3 for antibody 2709 (IGHV1-8)
ARGPIVRGVIRFDY

SEQ ID NO: 5419 - protein, 9 aa, Homo sapiens
  Light chain CDR3 for antibody 2710 (IGKV1-9)
QQLNSYPYT

SEQ ID NO: 5420 - protein, 13 aa, Homo sapiens
  Heavy chain CDR3 for antibody 2710 (IGHV6-1)
ARGKFDYYYGMDV

SEQ ID NO: 5421 - protein, 9 aa, Homo sapiens
  Light chain CDR3 for antibody 2711 (IGKV1-9)
QQLNSYPFT

SEQ ID NO: 5422 - protein, 17 aa, Homo sapiens
  Heavy chain CDR3 for antibody 2711 (IGHV3-11)
AREITMFRGDNYYGIDV

SEQ ID NO: 5423 - protein, 9 aa, Homo sapiens
  Light chain CDR3 for antibody 2712 (IGKV1-9)
QQLNSYPFT

SEQ ID NO: 5424 - protein, 17 aa, Homo sapiens
  Heavy chain CDR3 for antibody 2712 (IGHV3-33)
ARESAIVRGDNYYGMDV

SEQ ID NO: 5425 - protein, 9 aa, Homo sapiens
  Light chain CDR3 for antibody 2713 (IGKV1D-17)
LQHNSYPYT

SEQ ID NO: 5426 - protein, 13 aa, Homo sapiens
  Heavy chain CDR3 for antibody 2713 (IGHV1-24)
ATHYDILTGYFDY

SEQ ID NO: 5427 - protein, 9 aa, Homo sapiens
  Light chain CDR3 for antibody 2714 (IGKV3-20)
QQYGSSPLT

SEQ ID NO: 5428 - protein, 14 aa, Homo sapiens
  Heavy chain CDR3 for antibody 2714 (IGHV4-59)
ARETMVRGVRGFDP

SEQ ID NO: 5429 - protein, 9 aa, Homo sapiens
  Light chain CDR3 for antibody 2715 (IGKV1D-17)
LQHNSYPYT

SEQ ID NO: 5430 - protein, 9 aa, Homo sapiens
  Heavy chain CDR3 for antibody 2715 (IGHV4-34)
ARGRGWFDP

SEQ ID NO: 5431 - protein, 9 aa, Homo sapiens
  Light chain CDR3 for antibody 2716 (IGKV1-9)
QQLNSYPFT

SEQ ID NO: 5432 - protein, 17 aa, Homo sapiens
  Heavy chain CDR3 for antibody 2716 (IGHV3-33)
AREITMFRGENYYGLDV

SEQ ID NO: 5433 - protein, 9 aa, Homo sapiens
  Light chain CDR3 for antibody 2717 (IGKV1-9)
QHLNSHPFT

SEQ ID NO: 5434 - protein, 17 aa, Homo sapiens
  Heavy chain CDR3 for antibody 2717 (IGHV3-30)
AREITMVRGDNYYALDV

SEQ ID NO: 5435 - protein, 9 aa, Homo sapiens
  Light chain CDR3 for antibody 2718 (IGKV1D-17)
LQHNSYPYT

SEQ ID NO: 5436 - protein, 10 aa, Homo sapiens
  Heavy chain CDR3 for antibody 2718 (IGHV3-33)
AIQSTYGMDV

SEQ ID NO: 5437 - protein, 9 aa, Homo sapiens
  Light chain CDR3 for antibody 2719 (IGKV1-8)
QQYYSYPLT

SEQ ID NO: 5438 - protein, 19 aa, Homo sapiens
  Heavy chain CDR3 for antibody 2719 (IGHV1-18)
ARDHGYCSSTSCYRAWFDP

SEQ ID NO: 5439 - protein, 9 aa, Homo sapiens
  Light chain CDR3 for antibody 2720 (IGKV1-9)
QHLNSHPFT

SEQ ID NO: 5440 - protein, 17 aa, Homo sapiens
  Heavy chain CDR3 for antibody 2720 (IGHV3-33)
AREITRVRGDSYYGMDV

SEQ ID NO: 5441 - protein, 8 aa, Homo sapiens
  Light chain CDR3 for antibody 2721 (IGKV1-6)
LQDYNYFT

SEQ ID NO: 5442 - protein, 13 aa, Homo sapiens
  Heavy chain CDR3 for antibody 2721 (IGHV3-33)
ARWYYDILTGFDY

SEQ ID NO: 5443 - protein, 9 aa, Homo sapiens
  Light chain CDR3 for antibody 2722 (IGKV1-9)
HQLNSYPYT

SEQ ID NO: 5444 - protein, 15 aa, Homo sapiens
  Heavy chain CDR3 for antibody 2722 (IGHV1-46)
AREKYYGSGTYPFDS

SEQ ID NO: 5445 - protein, 9 aa, Homo sapiens
  Light chain CDR3 for antibody 2723 (IGKV1-9)
HQLNSYPYT

SEQ ID NO: 5446 - protein, 15 aa, Homo sapiens
  Heavy chain CDR3 for antibody 2723 (IGHV1-46)
AREKYHGSGSSPFAY

SEQ ID NO: 5447 - protein, 9 aa, Homo sapiens
  Light chain CDR3 for antibody 2724 (IGKV1-9)
QQLISYPYT

SEQ ID NO: 5448 - protein, 13 aa, Homo sapiens
  Heavy chain CDR3 for antibody 2724 (IGHV1-18)
AREGGSFYVSFDY

SEQ ID NO: 5449 - protein, 9 aa, Homo sapiens
  Light chain CDR3 for antibody 2725 (IGKV1-9)
QQLNSHPFT

SEQ ID NO: 5450 - protein, 17 aa, Homo sapiens
  Heavy chain CDR3 for antibody 2725 (IGHV3-33)
AREITMVRGDNYYGIDV

SEQ ID NO: 5451 - protein, 9 aa, Homo sapiens
  Light chain CDR3 for antibody 2726 (IGKV1-27)
QKYNSAPLT

SEQ ID NO: 5452 - protein, 18 aa, Homo sapiens
  Heavy chain CDR3 for antibody 2726 (IGHV3-33)
ARDRGIAAAGTYYYGMDV

SEQ ID NO: 5453 - protein, 9 aa, Homo sapiens
  Light chain CDR3 for antibody 2727 (IGKV6-21)
HQSSSLPYT

SEQ ID NO: 5454 - protein, 16 aa, Homo sapiens
  Heavy chain CDR3 for antibody 2727 (IGHV1-18)
AREGETMGRGVIAFDY

SEQ ID NO: 5455 - protein, 9 aa, Homo sapiens
  Light chain CDR3 for antibody 2728 (IGKV1-13)
QQANSFPRT

SEQ ID NO: 5456 - protein, 15 aa, Homo sapiens
  Heavy chain CDR3 for antibody 2728 (IGHV3-33)
ARDYSTYYYYYGMDV

SEQ ID NO: 5457 - protein, 9 aa, Homo sapiens
  Light chain CDR3 for antibody 2729 (IGKV3D-20)
QQYGSSPWT

SEQ ID NO: 5458 - protein, 16 aa, Homo sapiens
  Heavy chain CDR3 for antibody 2729 (IGHV3-66)
ARGDYDILTGLDSLDY

SEQ ID NO: 5459 - protein, 9 aa, Homo sapiens
  Light chain CDR3 for antibody 2730 (IGKV1-9)
QQLNSYPPT

SEQ ID NO: 5460 - protein, 10 aa, Homo sapiens
  Heavy chain CDR3 for antibody 2730 (IGHV3-20)
ARGRGWGFDY

SEQ ID NO: 5461 - protein, 9 aa, Homo sapiens
  Light chain CDR3 for antibody 2731 (IGKV1-9)
QQLNSYPFT

SEQ ID NO: 5462 - protein, 17 aa, Homo sapiens
  Heavy chain CDR3 for antibody 2731 (IGHV3-33)
AREINRVRGDNYYGMEV

SEQ ID NO: 5463 - protein, 9 aa, Homo sapiens
  Light chain CDR3 for antibody 2732 (IGKV1-9)
QHLNSHPFT

SEQ ID NO: 5464 - protein, 17 aa, Homo sapiens
  Heavy chain CDR3 for antibody 2732 (IGHV3-33)
ASEITMVRGDNSYGMDV

SEQ ID NO: 5465 - protein, 9 aa, Homo sapiens
  Light chain CDR3 for antibody 2733 (IGKV1-9)
HQLNSYPYT

SEQ ID NO: 5466 - protein, 15 aa, Homo sapiens
  Heavy chain CDR3 for antibody 2733 (IGHV1-46)
AREKYYGAGSYPFDY

SEQ ID NO: 5467 - protein, 9 aa, Homo sapiens
  Light chain CDR3 for antibody 2734 (IGKV1-9)
QQFNSHPFT

SEQ ID NO: 5468 - protein, 17 aa, Homo sapiens
  Heavy chain CDR3 for antibody 2734 (IGHV3-33)
AREITLIRGDNYYGMDV

SEQ ID NO: 5469 - protein, 9 aa, Homo sapiens
  Light chain CDR3 for antibody 2735 (IGKV1-6)
LQDYNYPWT

SEQ ID NO: 5470 - protein, 10 aa, Homo sapiens
  Heavy chain CDR3 for antibody 2735 (IGHV3-33)
ARESTDGMDV

SEQ ID NO: 5471 - protein, 9 aa, Homo sapiens
  Light chain CDR3 for antibody 2736 (IGKV1-9)
HQLISYPYT

SEQ ID NO: 5472 - protein, 15 aa, Homo sapiens
  Heavy chain CDR3 for antibody 2736 (IGHV1-46)
AREKSYGSGSSPFDY

SEQ ID NO: 5473 - protein, 9 aa, Homo sapiens
  Light chain CDR3 for antibody 2737 (IGKV1D-17)
LQHNSYPYT

SEQ ID NO: 5474 - protein, 10 aa, Homo sapiens
  Heavy chain CDR3 for antibody 2737 (IGHV3-33)
ARESAAGIDY

SEQ ID NO: 5475 - protein, 9 aa, Homo sapiens
  Light chain CDR3 for antibody 2738 (IGKV1-9)
QQLNSYPYT

SEQ ID NO: 5476 - protein, 15 aa, Homo sapiens
  Heavy chain CDR3 for antibody 2738 (IGHV1-46)
AREKCYGSGSYAFDS

SEQ ID NO: 5477 - protein, 9 aa, Homo sapiens
  Light chain CDR3 for antibody 2739 (IGKV1-9)
QQLNSHPFT

SEQ ID NO: 5478 - protein, 17 aa, Homo sapiens
  Heavy chain CDR3 for antibody 2739 (IGHV3-33)
AREIAMVRGDNYYGMDF

SEQ ID NO: 5479 - protein, 9 aa, Homo sapiens
  Light chain CDR3 for antibody 2740 (IGKV1D-17)
LQHDSYPYT

SEQ ID NO: 5480 - protein, 10 aa, Homo sapiens
  Heavy chain CDR3 for antibody 2740 (IGHV3-33)
AREATDGMDV

SEQ ID NO: 5481 - protein, 9 aa, Homo sapiens
  Light chain CDR3 for antibody 2741 (IGKV1D-17)
LQHNSYPYT

SEQ ID NO: 5482 - protein, 10 aa, Homo sapiens
  Heavy chain CDR3 for antibody 2741 (IGHV3-33)
ARDAVAGFDS

SEQ ID NO: 5483 - protein, 9 aa, Homo sapiens
  Light chain CDR3 for antibody 2742 (IGKV1D-17)
LQHNSYPYT

SEQ ID NO: 5484 - protein, 13 aa, Homo sapiens
  Heavy chain CDR3 for antibody 2742 (IGHV3-33)
ARVLRYFDPDFDY

SEQ ID NO: 5485 - protein, 9 aa, Homo sapiens
  Light chain CDR3 for antibody 2743 (IGKV1-9)
QQLNSYPLT

SEQ ID NO: 5486 - protein, 17 aa, Homo sapiens
  Heavy chain CDR3 for antibody 2743 (IGHV1-18)
ARGIAVAGPYYYYGMDV

SEQ ID NO: 5487 - protein, 9 aa, Homo sapiens
  Light chain CDR3 for antibody 2744 (IGKV1-9)
QQLNSYPFT

SEQ ID NO: 5488 - protein, 17 aa, Homo sapiens
  Heavy chain CDR3 for antibody 2744 (IGHV3-33)
ARESTKVRGDNYYGMDV

SEQ ID NO: 5489 - protein, 9 aa, Homo sapiens
  Light chain CDR3 for antibody 2745 (IGKV1D-17)
LQHNSYPYT

SEQ ID NO: 5490 - protein, 16 aa, Homo sapiens
  Heavy chain CDR3 for antibody 2745 (IGHV3-33)
ARDRDIVATGEYYFDY

SEQ ID NO: 5491 - protein, 9 aa, Homo sapiens
  Light chain CDR3 for antibody 2746 (IGKV6-21)
HQSSSLPYT

SEQ ID NO: 5492 - protein, 16 aa, Homo sapiens
  Heavy chain CDR3 for antibody 2746 (IGHV1-18)
SREGETMVRGVIAFDY

SEQ ID NO: 5493 - protein, 9 aa, Homo sapiens
  Light chain CDR3 for antibody 2747 (IGKV1-6)
LQDYNYPYT

SEQ ID NO: 5494 - protein, 14 aa, Homo sapiens
  Heavy chain CDR3 for antibody 2747 (IGHV3-23)
AKERAVAALNWFDP

SEQ ID NO: 5495 - protein, 9 aa, Homo sapiens
  Light chain CDR3 for antibody 2748 (IGKV1D-17)
QQLNSHPFT

SEQ ID NO: 5496 - protein, 17 aa, Homo sapiens
  Heavy chain CDR3 for antibody 2748 (IGHV3-33)
ARDITMVRGDNYYGMDV

SEQ ID NO: 5497 - protein, 9 aa, Homo sapiens
  Light chain CDR3 for antibody 2749 (IGKV1D-17)
LQHNSYPYT

SEQ ID NO: 5498 - protein, 10 aa, Homo sapiens
  Heavy chain CDR3 for antibody 2749 (IGHV3-33)
ARASTDGMAV

SEQ ID NO: 5499 - protein, 9 aa, Homo sapiens
  Light chain CDR3 for antibody 2750 (IGKV1-9)
HQLNSYPYT

SEQ ID NO: 5500 - protein, 15 aa, Homo sapiens
  Heavy chain CDR3 for antibody 2750 (IGHV1-46)
AREKYHGSGSYPMDD

SEQ ID NO: 5501 - protein, 9 aa, Homo sapiens
  Light chain CDR3 for antibody 2751 (IGKV1D-17)
QQYYSYPLT

SEQ ID NO: 5502 - protein, 13 aa, Homo sapiens
  Heavy chain CDR3 for antibody 2751 (IGHV3-33)
ARDWYYGSASPYY

SEQ ID NO: 5503 - protein, 9 aa, Homo sapiens
  Light chain CDR3 for antibody 2752 (IGKV3D-20)
QQYNSYPWT

SEQ ID NO: 5504 - protein, 20 aa, Homo sapiens
  Heavy chain CDR3 for antibody 2752 (IGHV3-11)
ARGADILTGYYNYYYYGMDV

SEQ ID NO: 5505 - protein, 9 aa, Homo sapiens
  Light chain CDR3 for antibody 2753 (IGKV1-27)
QQLNSYPYT

SEQ ID NO: 5506 - protein, 15 aa, Homo sapiens
  Heavy chain CDR3 for antibody 2753 (IGHV1-46)
AREKDDGSGSYPIDY

SEQ ID NO: 5507 - protein, 9 aa, Homo sapiens
  Light chain CDR3 for antibody 2754 (IGKV1-12)
QQANSFPWT

SEQ ID NO: 5508 - protein, 13 aa, Homo sapiens
  Heavy chain CDR3 for antibody 2754 (IGHV1-18)
ARDWYYGSGSPYY

SEQ ID NO: 5509 - protein, 9 aa, Homo sapiens
  Light chain CDR3 for antibody 2755 (IGKV1D-17)
LQHNSYPYT

SEQ ID NO: 5510 - protein, 16 aa, Homo sapiens
  Heavy chain CDR3 for antibody 2755 (IGHV3-33)
AMTTVTTDYYYYGMDV

SEQ ID NO: 5511 - protein, 9 aa, Homo sapiens
  Light chain CDR3 for antibody 2756 (IGKV1-9)
QQLNSYPFT

SEQ ID NO: 5512 - protein, 17 aa, Homo sapiens
  Heavy chain CDR3 for antibody 2756 (IGHV3-33)
AREITLVRGDNYCGMDV

SEQ ID NO: 5513 - protein, 9 aa, Homo sapiens
  Light chain CDR3 for antibody 2757 (IGKV1D-17)
LQHNSYPYT

SEQ ID NO: 5514 - protein, 14 aa, Homo sapiens
  Heavy chain CDR3 for antibody 2757 (IGHV3-23)
AKERAVAGLNWFDP

SEQ ID NO: 5515 - protein, 9 aa, Homo sapiens
  Light chain CDR3 for antibody 2758 (IGKV1D-17)
LQHNSYPYT

SEQ ID NO: 5516 - protein, 10 aa, Homo sapiens
  Heavy chain CDR3 for antibody 2758 (IGHV3-33)
TIESTDGIDV

SEQ ID NO: 5517 - protein, 8 aa, Homo sapiens
  Light chain CDR3 for antibody 2759 (IGKV1D-13)
QQFNNYPT

SEQ ID NO: 5518 - protein, 10 aa, Homo sapiens
  Heavy chain CDR3 for antibody 2759 (IGHV3-33)
ARESTDGMDV

SEQ ID NO: 5519 - protein, 9 aa, Homo sapiens
  Light chain CDR3 for antibody 2760 (IGKV1-9)
QQLNSHPFT

SEQ ID NO: 5520 - protein, 17 aa, Homo sapiens
  Heavy chain CDR3 for antibody 2760 (IGHV3-33)
ERESTVVRGDNYYGMDV

SEQ ID NO: 5521 - protein, 9 aa, Homo sapiens
  Light chain CDR3 for antibody 2761 (IGKV1-6)
LQDYNYPYT

SEQ ID NO: 5522 - protein, 10 aa, Homo sapiens
  Heavy chain CDR3 for antibody 2761 (IGHV3-33)
ARETVAGFDY

SEQ ID NO: 5523 - protein, 9 aa, Homo sapiens
  Light chain CDR3 for antibody 2762 (IGKV1-9)
QRLNSYPYT

SEQ ID NO: 5524 - protein, 13 aa, Homo sapiens
  Heavy chain CDR3 for antibody 2762 (IGHV3-33)
ARDYCGGDCYPDP

SEQ ID NO: 5525 - protein, 9 aa, Homo sapiens
  Light chain CDR3 for antibody 2763 (IGKV1-9)
QQLNSYPYT

SEQ ID NO: 5526 - protein, 18 aa, Homo sapiens
  Heavy chain CDR3 for antibody 2763 (IGHV3-15)
TTDHSGYDHYYYYYGMDV

SEQ ID NO: 5527 - protein, 9 aa, Homo sapiens
  Light chain CDR3 for antibody 2764 (IGKV1D-17)
LQHNSYPYT

SEQ ID NO: 5528 - protein, 13 aa, Homo sapiens
  Heavy chain CDR3 for antibody 2764 (IGHV3-33)
ARDWYYGSGSPYY

SEQ ID NO: 5529 - protein, 9 aa, Homo sapiens
  Light chain CDR3 for antibody 2765 (IGKV1D-17)
LQHNSYPYT

SEQ ID NO: 5530 - protein, 10 aa, Homo sapiens
  Heavy chain CDR3 for antibody 2765 (IGHV3-33)
TIESTYAMDL

SEQ ID NO: 5531 - protein, 9 aa, Homo sapiens
  Light chain CDR3 for antibody 2766 (IGKV6-21)
HQSSSLPYT

SEQ ID NO: 5532 - protein, 16 aa, Homo sapiens
  Heavy chain CDR3 for antibody 2766 (IGHV1-18)
SRERDTMVRGFIAFDY

SEQ ID NO: 5533 - protein, 9 aa, Homo sapiens
  Light chain CDR3 for antibody 2767 (IGKV1-9)
QQLNSYPFT

SEQ ID NO: 5534 - protein, 17 aa, Homo sapiens
  Heavy chain CDR3 for antibody 2767 (IGHV3-33)
AREITLVRVDNYYAMDV

SEQ ID NO: 5535 - protein, 9 aa, Homo sapiens
  Light chain CDR3 for antibody 2768 (IGKV3-15)
QQYNNWPRT

SEQ ID NO: 5536 - protein, 19 aa, Homo sapiens
  Heavy chain CDR3 for antibody 2768 (IGHV1-18)
ARDHGYCSSTSCYRAWFDP

SEQ ID NO: 5537 - protein, 9 aa, Homo sapiens
  Light chain CDR3 for antibody 2769 (IGKV3-15)
QQYNNWPLT

SEQ ID NO: 5538 - protein, 15 aa, Homo sapiens
  Heavy chain CDR3 for antibody 2769 (IGHV1-46)
AREKYYGSGSYPFDY

SEQ ID NO: 5539 - protein, 9 aa, Homo sapiens
  Light chain CDR3 for antibody 2770 (IGKV1-9)
QQLNSYPFT

SEQ ID NO: 5540 - protein, 17 aa, Homo sapiens
  Heavy chain CDR3 for antibody 2770 (IGHV3-33)
EREINMVRGDNYYGMDV

SEQ ID NO: 5541 - protein, 9 aa, Homo sapiens
  Light chain CDR3 for antibody 2771 (IGKV1-9)
QQFNSHPFT

SEQ ID NO: 5542 - protein, 19 aa, Homo sapiens
  Heavy chain CDR3 for antibody 2771 (IGHV3-11)
ARDHGYCSSTSCYRAWFDP

SEQ ID NO: 5543 - protein, 9 aa, Homo sapiens
  Light chain CDR3 for antibody 2772 (IGKV1-9)
QQLNSYPFT

SEQ ID NO: 5544 - protein, 17 aa, Homo sapiens
  Heavy chain CDR3 for antibody 2772 (IGHV3-33)
AREITMVRGYNYYGIDV

SEQ ID NO: 5545 - protein, 9 aa, Homo sapiens
  Light chain CDR3 for antibody 2773 (IGKV1-9)
QQLNSFPFT

SEQ ID NO: 5546 - protein, 17 aa, Homo sapiens
  Heavy chain CDR3 for antibody 2773 (IGHV3-74)
AREITMVRGDTYYGMEV

SEQ ID NO: 5547 - protein, 9 aa, Homo sapiens
  Light chain CDR3 for antibody 2774 (IGKV1D-17)
LQHNSYPYT

SEQ ID NO: 5548 - protein, 10 aa, Homo sapiens
  Heavy chain CDR3 for antibody 2774 (IGHV3-33)
ARDSSDGMDV

SEQ ID NO: 5549 - protein, 9 aa, Homo sapiens
  Light chain CDR3 for antibody 2775 (IGKV1-9)
QQLNSYPFT

SEQ ID NO: 5550 - protein, 9 aa, Homo sapiens
  Heavy chain CDR3 for antibody 2775 (IGHV4-31)
ARDSGYFDY

SEQ ID NO: 5551 - protein, 9 aa, Homo sapiens
  Light chain CDR3 for antibody 2776 (IGKV1D-17)
QQLNSYPPT

SEQ ID NO: 5552 - protein, 18 aa, Homo sapiens
  Heavy chain CDR3 for antibody 2776 (IGHV3-11)
ARDVMGRGVMDYYYGMDV

SEQ ID NO: 5553 - protein, 9 aa, Homo sapiens
  Light chain CDR3 for antibody 2777 (IGKV1-9)
HQLISYPYT

SEQ ID NO: 5554 - protein, 15 aa, Homo sapiens
  Heavy chain CDR3 for antibody 2777 (IGHV1-46)
AREKYYGSESYPFDY

SEQ ID NO: 5555 - protein, 9 aa, Homo sapiens
  Light chain CDR3 for antibody 2778 (IGKV1-9)
LQHNSYPWT

SEQ ID NO: 5556 - protein, 17 aa, Homo sapiens
  Heavy chain CDR3 for antibody 2778 (IGHV3-33)
ARESTLVRGDNYYGMDV

SEQ ID NO: 5557 - protein, 9 aa, Homo sapiens
  Light chain CDR3 for antibody 2779 (IGKV1-9)
QQLNSYPFT

SEQ ID NO: 5558 - protein, 17 aa, Homo sapiens
  Heavy chain CDR3 for antibody 2779 (IGHV3-33)
AREINMVRGDNYSGMDG

SEQ ID NO: 5559 - protein, 9 aa, Homo sapiens
  Light chain CDR3 for antibody 2780 (IGKV1-9)
QQLNSHPFT

SEQ ID NO: 5560 - protein, 17 aa, Homo sapiens
  Heavy chain CDR3 for antibody 2780 (IGHV3-33)
AREITMVRGDDYYGMGV

SEQ ID NO: 5561 - protein, 8 aa, Homo sapiens
  Light chain CDR3 for antibody 2781 (IGKV1-5)
QQYNSYWT

SEQ ID NO: 5562 - protein, 13 aa, Homo sapiens
  Heavy chain CDR3 for antibody 2781 (IGHV1-24)
ATTYSGYAYYFDY

SEQ ID NO: 5563 - protein, 9 aa, Homo sapiens
  Light chain CDR3 for antibody 2782 (IGKV1D-17)
LQHNSYPYT

SEQ ID NO: 5564 - protein, 10 aa, Homo sapiens
  Heavy chain CDR3 for antibody 2782 (IGHV3-33)
AIESVAGFDS

SEQ ID NO: 5565 - protein, 9 aa, Homo sapiens
  Light chain CDR3 for antibody 2783 (IGKV1-9)
QHLNSHPFT

SEQ ID NO: 5566 - protein, 17 aa, Homo sapiens
  Heavy chain CDR3 for antibody 2783 (IGHV3-66)
AREITMDRGDNYYGMDA

SEQ ID NO: 5567 - protein, 9 aa, Homo sapiens
  Light chain CDR3 for antibody 2784 (IGKV1-9)
QHLNSHPFT

SEQ ID NO: 5568 - protein, 17 aa, Homo sapiens
  Heavy chain CDR3 for antibody 2784 (IGHV3-33)
AREITMFRGDNYYGMDV

SEQ ID NO: 5569 - protein, 9 aa, Homo sapiens
  Light chain CDR3 for antibody 2785 (IGKV1-9)
HQLNSYPYT

SEQ ID NO: 5570 - protein, 15 aa, Homo sapiens
  Heavy chain CDR3 for antibody 2785 (IGHV1-46)
AREKYYVSESYPFDY

SEQ ID NO: 5571 - protein, 9 aa, Homo sapiens
  Light chain CDR3 for antibody 2786 (IGKV1D-17)
LQHNSYPWT

SEQ ID NO: 5572 - protein, 9 aa, Homo sapiens
  Heavy chain CDR3 for antibody 2786 (IGHV3-66)
AREGAGIDS

SEQ ID NO: 5573 - protein, 9 aa, Homo sapiens
  Light chain CDR3 for antibody 2787 (IGKV1D-16)
QQLNSYPYT

SEQ ID NO: 5574 - protein, 9 aa, Homo sapiens
  Heavy chain CDR3 for antibody 2787 (IGHV3-33)
AREGAGVDY

SEQ ID NO: 5575 - protein, 9 aa, Homo sapiens
  Light chain CDR3 for antibody 2788 (IGKV1D-17)
LQHNSYPYT

SEQ ID NO: 5576 - protein, 10 aa, Homo sapiens
  Heavy chain CDR3 for antibody 2788 (IGHV3-33)
AGETSDGMDV

SEQ ID NO: 5577 - protein, 9 aa, Homo sapiens
  Light chain CDR3 for antibody 2789 (IGKV1-9)
QQFNSYPFT

SEQ ID NO: 5578 - protein, 17 aa, Homo sapiens
  Heavy chain CDR3 for antibody 2789 (IGHV3-33)
AREINLARGDNYYGMDV

SEQ ID NO: 5579 - protein, 9 aa, Homo sapiens
  Light chain CDR3 for antibody 2790 (IGKV1D-17)
LQHNSYPYT

SEQ ID NO: 5580 - protein, 10 aa, Homo sapiens
  Heavy chain CDR3 for antibody 2790 (IGHV3-64)
ARATVAAFDY

SEQ ID NO: 5581 - protein, 9 aa, Homo sapiens
  Light chain CDR3 for antibody 2791 (IGKV1-9)
QQLISYPYT

SEQ ID NO: 5582 - protein, 17 aa, Homo sapiens
  Heavy chain CDR3 for antibody 2791 (IGHV3-33)
AREITMLRGDNYYGLDV

SEQ ID NO: 5583 - protein, 9 aa, Homo sapiens
  Light chain CDR3 for antibody 2792 (IGKV1D-17)
LQHNSHPFT

SEQ ID NO: 5584 - protein, 17 aa, Homo sapiens
  Heavy chain CDR3 for antibody 2792 (IGHV3-33)
AREITMVRGDNYYGLDV

SEQ ID NO: 5585 - protein, 8 aa, Homo sapiens
  Light chain CDR3 for antibody 2793 (IGKV1-9)
QQFNNYPT

SEQ ID NO: 5586 - protein, 17 aa, Homo sapiens
  Heavy chain CDR3 for antibody 2793 (IGHV3-33)
AREITMVRGDNYYGMDV

SEQ ID NO: 5587 - protein, 9 aa, Homo sapiens
  Light chain CDR3 for antibody 2794 (IGKV1-9)
QQLNSYPYT

SEQ ID NO: 5588 - protein, 15 aa, Homo sapiens
  Heavy chain CDR3 for antibody 2794 (IGHV1-46)
GGEKYYGSGSYPFDS

SEQ ID NO: 5589 - protein, 9 aa, Homo sapiens
  Light chain CDR3 for antibody 2795 (IGKV1-9)
QQLNSYPFT

SEQ ID NO: 5590 - protein, 17 aa, Homo sapiens
  Heavy chain CDR3 for antibody 2795 (IGHV3-33)
AREITLVRGDNYYGIAV

SEQ ID NO: 5591 - protein, 9 aa, Homo sapiens
  Light chain CDR3 for antibody 2796 (IGKV1D-17)
LQHNSYPYT

SEQ ID NO: 5592 - protein, 10 aa, Homo sapiens
  Heavy chain CDR3 for antibody 2796 (IGHV3-33)
AGGSTDGIDV

SEQ ID NO: 5593 - protein, 9 aa, Homo sapiens
  Light chain CDR3 for antibody 2797 (IGKV1-9)
QQYYSYPQT

SEQ ID NO: 5594 - protein, 5 aa, Homo sapiens
  Heavy chain CDR3 for antibody 2797 (IGHV4-39)
ASLDY

SEQ ID NO: 5595 - protein, 9 aa, Homo sapiens
  Light chain CDR3 for antibody 2798 (IGKV1-9)
QQLNSHPFT

SEQ ID NO: 5596 - protein, 17 aa, Homo sapiens
  Heavy chain CDR3 for antibody 2798 (IGHV3-33)
AREIAMVRGDNYDGMDV

SEQ ID NO: 5597 - protein, 9 aa, Homo sapiens
  Light chain CDR3 for antibody 2799 (IGKV6-21)
HQSSSLPWT

SEQ ID NO: 5598 - protein, 19 aa, Homo sapiens
  Heavy chain CDR3 for antibody 2799 (IGHV3-66)
ARDRGGSGWPDYYYYGMDV

SEQ ID NO: 5599 - protein, 9 aa, Homo sapiens
  Light chain CDR3 for antibody 2800 (IGKV1-9)
QQLNSYPYT

SEQ ID NO: 5600 - protein, 15 aa, Homo sapiens
  Heavy chain CDR3 for antibody 2800 (IGHV1-46)
AREKYYGSGSYPIDD

SEQ ID NO: 5601 - protein, 9 aa, Homo sapiens
  Light chain CDR3 for antibody 2801 (IGKV1-9)
QQLISYPYT

SEQ ID NO: 5602 - protein, 15 aa, Homo sapiens
  Heavy chain CDR3 for antibody 2801 (IGHV1-46)
SREKYYGSGSYPFNS

SEQ ID NO: 5603 - protein, 9 aa, Homo sapiens
  Light chain CDR3 for antibody 2802 (IGKV3-15)
QQYNNWPLT

SEQ ID NO: 5604 - protein, 9 aa, Homo sapiens
  Heavy chain CDR3 for antibody 2802 (IGHV4-31)
ARDSASFDY

SEQ ID NO: 5605 - protein, 9 aa, Homo sapiens
  Light chain CDR3 for antibody 2803 (IGKV1-9)
QQLISYPYT

SEQ ID NO: 5606 - protein, 15 aa, Homo sapiens
  Heavy chain CDR3 for antibody 2803 (IGHV1-46)
AREKYHGSGSYPIDY

SEQ ID NO: 5607 - protein, 9 aa, Homo sapiens
  Light chain CDR3 for antibody 2804 (IGKV1D-17)
LQHNSYPYT

SEQ ID NO: 5608 - protein, 10 aa, Homo sapiens
  Heavy chain CDR3 for antibody 2804 (IGHV3-33)
AIESTDAINV

SEQ ID NO: 5609 - protein, 9 aa, Homo sapiens
  Light chain CDR3 for antibody 2805 (IGKV6-21)
HQSSSLPYT

SEQ ID NO: 5610 - protein, 16 aa, Homo sapiens
  Heavy chain CDR3 for antibody 2805 (IGHV1-18)
AREEDTMVRGVNAFDY

SEQ ID NO: 5611 - protein, 9 aa, Homo sapiens
  Light chain CDR3 for antibody 2806 (IGKV1D-17)
QQLNSYPFT

SEQ ID NO: 5612 - protein, 16 aa, Homo sapiens
  Heavy chain CDR3 for antibody 2806 (IGHV3-23)
AKDSGSYHYYYYGMDV

SEQ ID NO: 5613 - protein, 9 aa, Homo sapiens
  Light chain CDR3 for antibody 2807 (IGKV1D-17)
LQHNSYPYT

SEQ ID NO: 5614 - protein, 9 aa, Homo sapiens
  Heavy chain CDR3 for antibody 2807 (IGHV3-33)
AREGAGIDY

SEQ ID NO: 5615 - protein, 9 aa, Homo sapiens
  Light chain CDR3 for antibody 2808 (IGKV1D-17)
QQLNSHPFT

SEQ ID NO: 5616 - protein, 17 aa, Homo sapiens
  Heavy chain CDR3 for antibody 2808 (IGHV3-30)
AREITMVRGDKYYGMDG

SEQ ID NO: 5617 - protein, 9 aa, Homo sapiens
  Light chain CDR3 for antibody 2809 (IGKV1-9)
QHLNSHPFT

SEQ ID NO: 5618 - protein, 9 aa, Homo sapiens
  Heavy chain CDR3 for antibody 2809 (IGHV3-33)
AREGAGVDY

SEQ ID NO: 5619 - protein, 9 aa, Homo sapiens
  Light chain CDR3 for antibody 2810 (IGKV1-9)
QQLNSYPFT

SEQ ID NO: 5620 - protein, 17 aa, Homo sapiens
  Heavy chain CDR3 for antibody 2810 (IGHV3-33)
VREITRARGDNYYGLDV

SEQ ID NO: 5621 - protein, 9 aa, Homo sapiens
  Light chain CDR3 for antibody 2811 (IGKV3-15)
QQYNNWPRT

SEQ ID NO: 5622 - protein, 13 aa, Homo sapiens
  Heavy chain CDR3 for antibody 2811 (IGHV3-66)
ARDDSSGWYYFDY

SEQ ID NO: 5623 - protein, 9 aa, Homo sapiens
  Light chain CDR3 for antibody 2812 (IGKV1D-17)
LQHNSYPYT

SEQ ID NO: 5624 - protein, 10 aa, Homo sapiens
  Heavy chain CDR3 for antibody 2812 (IGHV3-33)
ARAAVTGFDY

SEQ ID NO: 5625 - protein, 9 aa, Homo sapiens
  Light chain CDR3 for antibody 2813 (IGKV1-6)
LQDYNYPYT

SEQ ID NO: 5626 - protein, 15 aa, Homo sapiens
  Heavy chain CDR3 for antibody 2813 (IGHV4-59)
AGRSSHYYYYYGMDV

SEQ ID NO: 5627 - protein, 9 aa, Homo sapiens
  Light chain CDR3 for antibody 2814 (IGKV1-9)
QQLNGYPYT

SEQ ID NO: 5628 - protein, 10 aa, Homo sapiens
  Heavy chain CDR3 for antibody 2814 (IGHV3-33)
ARESTDGMDV

SEQ ID NO: 5629 - protein, 9 aa, Homo sapiens
  Light chain CDR3 for antibody 2815 (IGKV1-9)
QQLNSYPFT

SEQ ID NO: 5630 - protein, 17 aa, Homo sapiens
  Heavy chain CDR3 for antibody 2815 (IGHV3-30)
ARESKMVRGANYYAMDD

SEQ ID NO: 5631 - protein, 9 aa, Homo sapiens
  Light chain CDR3 for antibody 2816 (IGKV3-15)
QQYNNWPRT

SEQ ID NO: 5632 - protein, 16 aa, Homo sapiens
  Heavy chain CDR3 for antibody 2816 (IGHV3-33)
ARDRDIVATGEYSFDS

SEQ ID NO: 5633 - protein, 9 aa, Homo sapiens
  Light chain CDR3 for antibody 2817 (IGKV1-9)
QQFNSHPFT

SEQ ID NO: 5634 - protein, 10 aa, Homo sapiens
  Heavy chain CDR3 for antibody 2817 (IGHV3-33)
AREATDGMAV

SEQ ID NO: 5635 - protein, 9 aa, Homo sapiens
  Light chain CDR3 for antibody 2818 (IGKV1D-17)
LQHNSYPYT

SEQ ID NO: 5636 - protein, 17 aa, Homo sapiens
  Heavy chain CDR3 for antibody 2818 (IGHV3-33)
AREITMLRGDNYYGLDV

SEQ ID NO: 5637 - protein, 9 aa, Homo sapiens
  Light chain CDR3 for antibody 2819 (IGKV1-8)
QQYYSYPLT

SEQ ID NO: 5638 - protein, 14 aa, Homo sapiens
  Heavy chain CDR3 for antibody 2819 (IGHV3-23)
AKNRAVAGLNWFEP

SEQ ID NO: 5639 - protein, 9 aa, Homo sapiens
  Light chain CDR3 for antibody 2820 (IGKV1D-17)
LQHNSYPYT

SEQ ID NO: 5640 - protein, 14 aa, Homo sapiens
  Heavy chain CDR3 for antibody 2820 (IGHV3-23)
AKAIAVAGTWYFDL

SEQ ID NO: 5641 - protein, 9 aa, Homo sapiens
  Light chain CDR3 for antibody 2821 (IGKV1D-17)
LQHNSYPYT

SEQ ID NO: 5642 - protein, 15 aa, Homo sapiens
  Heavy chain CDR3 for antibody 2821 (IGHV1-46)
AREKSHGSGSSPFDS

SEQ ID NO: 5643 - protein, 9 aa, Homo sapiens
  Light chain CDR3 for antibody 2822 (IGKV1-9)
QQFNSYPFT

SEQ ID NO: 5644 - protein, 10 aa, Homo sapiens
  Heavy chain CDR3 for antibody 2822 (IGHV3-33)
ARGVWFGADY

SEQ ID NO: 5645 - protein, 9 aa, Homo sapiens
  Light chain CDR3 for antibody 2823 (IGKV1-9)
HQLNSYPYT

SEQ ID NO: 5646 - protein, 15 aa, Homo sapiens
  Heavy chain CDR3 for antibody 2823 (IGHV1-46)
AGEKYYGSGSSPFDY

SEQ ID NO: 5647 - protein, 9 aa, Homo sapiens
  Light chain CDR3 for antibody 2824 (IGKV1-9)
QQLNSYPYT

SEQ ID NO: 5648 - protein, 15 aa, Homo sapiens
  Heavy chain CDR3 for antibody 2824 (IGHV1-46)
SREKYYGSGTSPFDY

SEQ ID NO: 5649 - protein, 9 aa, Homo sapiens
  Light chain CDR3 for antibody 2825 (IGKV1-9)
QQLISYPYT

SEQ ID NO: 5650 - protein, 15 aa, Homo sapiens
  Heavy chain CDR3 for antibody 2825 (IGHV1-46)
AREKYYGSGSSPFES

SEQ ID NO: 5651 - protein, 9 aa, Homo sapiens
  Light chain CDR3 for antibody 2826 (IGKV1-6)
QKYNSAPLT

SEQ ID NO: 5652 - protein, 10 aa, Homo sapiens
  Heavy chain CDR3 for antibody 2826 (IGHV3-33)
ARESVAGFDY

SEQ ID NO: 5653 - protein, 9 aa, Homo sapiens
  Light chain CDR3 for antibody 2827 (IGKV1-9)
QHLNSHPFT

SEQ ID NO: 5654 - protein, 17 aa, Homo sapiens
  Heavy chain CDR3 for antibody 2827 (IGHV3-33)
AREIAVVRGDNYYGMDV

SEQ ID NO: 5655 - protein, 9 aa, Homo sapiens
  Light chain CDR3 for antibody 2828 (IGKV1-9)
QQLNSYPPT

SEQ ID NO: 5656 - protein, 16 aa, Homo sapiens
  Heavy chain CDR3 for antibody 2828 (IGHV1-18)
AMTTVTTDYYYYGMDV

SEQ ID NO: 5657 - protein, 9 aa, Homo sapiens
  Light chain CDR3 for antibody 2829 (IGKV1D-17)
LQHNSYPYT

SEQ ID NO: 5658 - protein, 10 aa, Homo sapiens
  Heavy chain CDR3 for antibody 2829 (IGHV3-30)
TRESTDAMDV

SEQ ID NO: 5659 - protein, 9 aa, Homo sapiens
  Light chain CDR3 for antibody 2830 (IGKV1D-17)
LQHNSYPYT

SEQ ID NO: 5660 - protein, 18 aa, Homo sapiens
  Heavy chain CDR3 for antibody 2830 (IGHV3-33)
ARYGDPERDYYYYYGMEV

SEQ ID NO: 5661 - protein, 9 aa, Homo sapiens
  Light chain CDR3 for antibody 2831 (IGKV1D-17)
QHLNSHPFT

SEQ ID NO: 5662 - protein, 12 aa, Homo sapiens
  Heavy chain CDR3 for antibody 2831 (IGHV4-39)
ARQGSYINWFDP

SEQ ID NO: 5663 - protein, 9 aa, Homo sapiens
  Light chain CDR3 for antibody 2832 (IGKV1D-17)
LQHNSYPWA

SEQ ID NO: 5664 - protein, 10 aa, Homo sapiens
  Heavy chain CDR3 for antibody 2832 (IGHV3-33)
AREATDGMAV

SEQ ID NO: 5665 - protein, 9 aa, Homo sapiens
  Light chain CDR3 for antibody 2833 (IGKV1-9)
QHLNSHPFT

SEQ ID NO: 5666 - protein, 17 aa, Homo sapiens
  Heavy chain CDR3 for antibody 2833 (IGHV3-33)
ARAITMVRGANYYGMDV

SEQ ID NO: 5667 - protein, 9 aa, Homo sapiens
  Light chain CDR3 for antibody 2834 (IGKV1D-17)
HQLNSYPYT

SEQ ID NO: 5668 - protein, 15 aa, Homo sapiens
  Heavy chain CDR3 for antibody 2834 (IGHV1-46)
AREKYYGSGRYPFAY

SEQ ID NO: 5669 - protein, 9 aa, Homo sapiens
  Light chain CDR3 for antibody 2835 (IGKV1-8)
QQYYSYPYT

SEQ ID NO: 5670 - protein, 14 aa, Homo sapiens
  Heavy chain CDR3 for antibody 2835 (IGHV3-23)
AKQEAVAGLNWIDP

SEQ ID NO: 5671 - protein, 9 aa, Homo sapiens
  Light chain CDR3 for antibody 2836 (IGKV1-9)
QQINSHPFT

SEQ ID NO: 5672 - protein, 17 aa, Homo sapiens
  Heavy chain CDR3 for antibody 2836 (IGHV3-33)
AREITMVRGDNYYGMNV

SEQ ID NO: 5673 - protein, 9 aa, Homo sapiens
  Light chain CDR3 for antibody 2837 (IGKV1-9)
HQLISYPYT

SEQ ID NO: 5674 - protein, 15 aa, Homo sapiens
  Heavy chain CDR3 for antibody 2837 (IGHV1-46)
AREKDYGSGSYAFDY

SEQ ID NO: 5675 - protein, 9 aa, Homo sapiens
  Light chain CDR3 for antibody 2838 (IGKV1-6)
LQDYNYLYT

SEQ ID NO: 5676 - protein, 17 aa, Homo sapiens
  Heavy chain CDR3 for antibody 2838 (IGHV4-39)
ARKYYDILTGTPLAFDI

SEQ ID NO: 5677 - protein, 9 aa, Homo sapiens
  Light chain CDR3 for antibody 2839 (IGKV1-6)
LQDYNYPWT

SEQ ID NO: 5678 - protein, 17 aa, Homo sapiens
  Heavy chain CDR3 for antibody 2839 (IGHV3-33)
AREGPYSSSWYGDWFEP

SEQ ID NO: 5679 - protein, 9 aa, Homo sapiens
  Light chain CDR3 for antibody 2840 (IGKV6-21)
HQSSSLPYT

SEQ ID NO: 5680 - protein, 16 aa, Homo sapiens
  Heavy chain CDR3 for antibody 2840 (IGHV1-18)
SREGYTMVPGVIAFDY

SEQ ID NO: 5681 - protein, 9 aa, Homo sapiens
  Light chain CDR3 for antibody 2841 (IGKV1-9)
QQLNSYPYT

SEQ ID NO: 5682 - protein, 15 aa, Homo sapiens
  Heavy chain CDR3 for antibody 2841 (IGHV1-46)
AREKYYGSGSYPYDS

SEQ ID NO: 5683 - protein, 9 aa, Homo sapiens
  Light chain CDR3 for antibody 2842 (IGKV1-9)
QQLNSYPYT

SEQ ID NO: 5684 - protein, 15 aa, Homo sapiens
  Heavy chain CDR3 for antibody 2842 (IGHV1-46)
AREKYYGSATYAFDY

SEQ ID NO: 5685 - protein, 9 aa, Homo sapiens
  Light chain CDR3 for antibody 2843 (IGKV1D-17)
LQHDSYPYT

SEQ ID NO: 5686 - protein, 10 aa, Homo sapiens
  Heavy chain CDR3 for antibody 2843 (IGHV3-33)
ARASTDAMDD

SEQ ID NO: 5687 - protein, 9 aa, Homo sapiens
  Light chain CDR3 for antibody 2844 (IGKV1-9)
QHLNSHPFT

SEQ ID NO: 5688 - protein, 17 aa, Homo sapiens
  Heavy chain CDR3 for antibody 2844 (IGHV3-66)
AREITMARGDNSYGMAV

SEQ ID NO: 5689 - protein, 9 aa, Homo sapiens
  Light chain CDR3 for antibody 2845 (IGKV1-9)
QQLNSYPFT

SEQ ID NO: 5690 - protein, 16 aa, Homo sapiens
  Heavy chain CDR3 for antibody 2845 (IGHV3-33)
ARDRDIVATGEYYFDY

SEQ ID NO: 5691 - protein, 9 aa, Homo sapiens
  Light chain CDR3 for antibody 2846 (IGKV6-21)
HQSSSLPYT

SEQ ID NO: 5692 - protein, 18 aa, Homo sapiens
  Heavy chain CDR3 for antibody 2846 (IGHV1-18)
AREGETMVRGDNYYGMDV

SEQ ID NO: 5693 - protein, 9 aa, Homo sapiens
  Light chain CDR3 for antibody 2847 (IGKV1D-17)
LQHNSYPYT

SEQ ID NO: 5694 - protein, 10 aa, Homo sapiens
  Heavy chain CDR3 for antibody 2847 (IGHV3-33)
ARASPDGIDA

SEQ ID NO: 5695 - protein, 9 aa, Homo sapiens
  Light chain CDR3 for antibody 2848 (IGKV1-9)
QQLNSYPFT

SEQ ID NO: 5696 - protein, 17 aa, Homo sapiens
  Heavy chain CDR3 for antibody 2848 (IGHV3-30)
AKKITMVRGDNYYAIDV

SEQ ID NO: 5697 - protein, 9 aa, Homo sapiens
  Light chain CDR3 for antibody 2849 (IGKV1-9)
HQLISYPYT

SEQ ID NO: 5698 - protein, 15 aa, Homo sapiens
  Heavy chain CDR3 for antibody 2849 (IGHV1-46)
ARKKYYGSGTYPFDY

SEQ ID NO: 5699 - protein, 9 aa, Homo sapiens
  Light chain CDR3 for antibody 2850 (IGKV1-9)
QQLNSYPFT

SEQ ID NO: 5700 - protein, 17 aa, Homo sapiens
  Heavy chain CDR3 for antibody 2850 (IGHV3-33)
AREIAVVRRENYYGMDV

SEQ ID NO: 5701 - protein, 9 aa, Homo sapiens
  Light chain CDR3 for antibody 2851 (IGKV1D-17)
LQHNSYPYT

SEQ ID NO: 5702 - protein, 10 aa, Homo sapiens
  Heavy chain CDR3 for antibody 2851 (IGHV3-33)
AREAPDAMAV

SEQ ID NO: 5703 - protein, 9 aa, Homo sapiens
  Light chain CDR3 for antibody 2852 (IGKV1-6)
QKYNSAPLT

SEQ ID NO: 5704 - protein, 13 aa, Homo sapiens
  Heavy chain CDR3 for antibody 2852 (IGHV3-66)
ARDWYYGSASTYY

SEQ ID NO: 5705 - protein, 9 aa, Homo sapiens
  Light chain CDR3 for antibody 2853 (IGKV1-9)
QQLNSYPFT

SEQ ID NO: 5706 - protein, 17 aa, Homo sapiens
  Heavy chain CDR3 for antibody 2853 (IGHV3-33)
AREITVVRVDNYYGMAV

SEQ ID NO: 5707 - protein, 9 aa, Homo sapiens
  Light chain CDR3 for antibody 2854 (IGKV1-9)
QQLNSHPFT

SEQ ID NO: 5708 - protein, 17 aa, Homo sapiens
  Heavy chain CDR3 for antibody 2854 (IGHV3-33)
AKEMTMARGDNYYGMDV

SEQ ID NO: 5709 - protein, 9 aa, Homo sapiens
  Light chain CDR3 for antibody 2855 (IGKV1D-17)
LQHNSYPYT

SEQ ID NO: 5710 - protein, 9 aa, Homo sapiens
  Heavy chain CDR3 for antibody 2855 (IGHV3-33)
AREGDYLDY

SEQ ID NO: 5711 - protein, 9 aa, Homo sapiens
  Light chain CDR3 for antibody 2856 (IGKV1-9)
QQLNSYPFT

SEQ ID NO: 5712 - protein, 14 aa, Homo sapiens
  Heavy chain CDR3 for antibody 2856 (IGHV3-23)
AKERAVAGLNWFDP

SEQ ID NO: 5713 - protein, 9 aa, Homo sapiens
  Light chain CDR3 for antibody 2857 (IGKV1D-17)
QQLNSYPFT

SEQ ID NO: 5714 - protein, 18 aa, Homo sapiens
  Heavy chain CDR3 for antibody 2857 (IGHV3-11)
ASDRGIAAAGTYYYGMDV

SEQ ID NO: 5715 - protein, 9 aa, Homo sapiens
  Light chain CDR3 for antibody 2858 (IGKV1D-17)
LQLNSHPFT

SEQ ID NO: 5716 - protein, 17 aa, Homo sapiens
  Heavy chain CDR3 for antibody 2858 (IGHV3-33)
AREITMVRGDNYYCMDV

SEQ ID NO: 5717 - protein, 9 aa, Homo sapiens
  Light chain CDR3 for antibody 2859 (IGKV1-9)
QQLNSYPYT

SEQ ID NO: 5718 - protein, 15 aa, Homo sapiens
  Heavy chain CDR3 for antibody 2859 (IGHV1-46)
ARQKYYGSESYPFDS

SEQ ID NO: 5719 - protein, 9 aa, Homo sapiens
  Light chain CDR3 for antibody 2860 (IGKV1-9)
QQLNSYPFT

SEQ ID NO: 5720 - protein, 17 aa, Homo sapiens
  Heavy chain CDR3 for antibody 2860 (IGHV3-33)
ASESTRERGDNYYGMDD

SEQ ID NO: 5721 - protein, 9 aa, Homo sapiens
  Light chain CDR3 for antibody 2861 (IGKV1-9)
QQLNSYPFT

SEQ ID NO: 5722 - protein, 17 aa, Homo sapiens
  Heavy chain CDR3 for antibody 2861 (IGHV3-33)
AREVTVIRGDNYYGMDV

SEQ ID NO: 5723 - protein, 9 aa, Homo sapiens
  Light chain CDR3 for antibody 2862 (IGKV1-9)
QQLNSYPYT

SEQ ID NO: 5724 - protein, 15 aa, Homo sapiens
  Heavy chain CDR3 for antibody 2862 (IGHV1-46)
EREKYHGSGSYPFDY

SEQ ID NO: 5725 - protein, 9 aa, Homo sapiens
  Light chain CDR3 for antibody 2863 (IGKV1D-17)
LQHDSYPYT

SEQ ID NO: 5726 - protein, 10 aa, Homo sapiens
  Heavy chain CDR3 for antibody 2863 (IGHV3-33)
AIESTYAMDA

SEQ ID NO: 5727 - protein, 9 aa, Homo sapiens
  Light chain CDR3 for antibody 2864 (IGKV1D-16)
QQYNSYPYT

SEQ ID NO: 5728 - protein, 13 aa, Homo sapiens
  Heavy chain CDR3 for antibody 2864 (IGHV3-33)
ARRDSSSWYEFDY

SEQ ID NO: 5729 - protein, 9 aa, Homo sapiens
  Light chain CDR3 for antibody 2865 (IGKV1-9)
HQLNSYPYT

SEQ ID NO: 5730 - protein, 15 aa, Homo sapiens
  Heavy chain CDR3 for antibody 2865 (IGHV1-46)
AREKYHGSGNYPFDY

SEQ ID NO: 5731 - protein, 9 aa, Homo sapiens
  Light chain CDR3 for antibody 2866 (IGKV1-9)
QQFNSYPFT

SEQ ID NO: 5732 - protein, 17 aa, Homo sapiens
  Heavy chain CDR3 for antibody 2866 (IGHV3-33)
GRESTMVRGENAYGMDV

SEQ ID NO: 5733 - protein, 9 aa, Homo sapiens
  Light chain CDR3 for antibody 2867 (IGKV1-9)
QHLNSHPFT

SEQ ID NO: 5734 - protein, 17 aa, Homo sapiens
  Heavy chain CDR3 for antibody 2867 (IGHV3-33)
AREITRIRGDNYYGMDA

SEQ ID NO: 5735 - protein, 9 aa, Homo sapiens
  Light chain CDR3 for antibody 2868 (IGKV1-9)
HQLNSYPYT

SEQ ID NO: 5736 - protein, 10 aa, Homo sapiens
  Heavy chain CDR3 for antibody 2868 (IGHV3-33)
ASESTDGMEA

SEQ ID NO: 5737 - protein, 9 aa, Homo sapiens
  Light chain CDR3 for antibody 2869 (IGKV1-9)
QQLNGYPYT

SEQ ID NO: 5738 - protein, 15 aa, Homo sapiens
  Heavy chain CDR3 for antibody 2869 (IGHV1-46)
AREKYYGSGSYAFDD

SEQ ID NO: 5739 - protein, 9 aa, Homo sapiens
  Light chain CDR3 for antibody 2870 (IGKV6-21)
HQSSSLPYT

SEQ ID NO: 5740 - protein, 16 aa, Homo sapiens
  Heavy chain CDR3 for antibody 2870 (IGHV1-18)
AREGETRGRGVIAFDY

SEQ ID NO: 5741 - protein, 9 aa, Homo sapiens
  Light chain CDR3 for antibody 2871 (IGKV1-9)
QQLISYPYT

SEQ ID NO: 5742 - protein, 15 aa, Homo sapiens
  Heavy chain CDR3 for antibody 2871 (IGHV1-46)
AIEKYYGSCSYPFYS

SEQ ID NO: 5743 - protein, 9 aa, Homo sapiens
  Light chain CDR3 for antibody 2872 (IGKV6-21)
HQSSSLPYT

SEQ ID NO: 5744 - protein, 16 aa, Homo sapiens
  Heavy chain CDR3 for antibody 2872 (IGHV1-18)
AREGETMVRGFIAFHY

SEQ ID NO: 5745 - protein, 9 aa, Homo sapiens
  Light chain CDR3 for antibody 2873 (IGKV1-9)
QQLNSYPFT

SEQ ID NO: 5746 - protein, 17 aa, Homo sapiens
  Heavy chain CDR3 for antibody 2873 (IGHV4-59)
ARTLFWFGELGGWYFDL

SEQ ID NO: 5747 - protein, 9 aa, Homo sapiens
  Light chain CDR3 for antibody 2874 (IGKV1-9)
QQLNSHPFT

SEQ ID NO: 5748 - protein, 17 aa, Homo sapiens
  Heavy chain CDR3 for antibody 2874 (IGHV3-33)
AREITRVRGDNYYGMDD

SEQ ID NO: 5749 - protein, 9 aa, Homo sapiens
  Light chain CDR3 for antibody 2875 (IGKV1-9)
QQLNSYPYT

SEQ ID NO: 5750 - protein, 15 aa, Homo sapiens
  Heavy chain CDR3 for antibody 2875 (IGHV1-46)
AREKYYGSDTSPFDY

SEQ ID NO: 5751 - protein, 9 aa, Homo sapiens
  Light chain CDR3 for antibody 2876 (IGKV1-9)
QQLNSYPFT

SEQ ID NO: 5752 - protein, 17 aa, Homo sapiens
  Heavy chain CDR3 for antibody 2876 (IGHV3-33)
ARQITLVRGDNYYGMNV

SEQ ID NO: 5753 - protein, 9 aa, Homo sapiens
  Light chain CDR3 for antibody 2877 (IGKV1-9)
QQLNSYPYT

SEQ ID NO: 5754 - protein, 15 aa, Homo sapiens
  Heavy chain CDR3 for antibody 2877 (IGHV1-46)
AREKCYGAGSYPFDY

SEQ ID NO: 5755 - protein, 9 aa, Homo sapiens
  Light chain CDR3 for antibody 2878 (IGKV1-9)
HQLISYPYT

SEQ ID NO: 5756 - protein, 15 aa, Homo sapiens
  Heavy chain CDR3 for antibody 2878 (IGHV1-46)
AREKCYGSGSYPFDY

SEQ ID NO: 5757 - protein, 9 aa, Homo sapiens
  Light chain CDR3 for antibody 2879 (IGKV1D-17)
LQHNSYPYT

SEQ ID NO: 5758 - protein, 10 aa, Homo sapiens
  Heavy chain CDR3 for antibody 2879 (IGHV3-33)
ARKSTDAIDA

SEQ ID NO: 5759 - protein, 9 aa, Homo sapiens
  Light chain CDR3 for antibody 2880 (IGKV1-9)
HQLNSYPYT

SEQ ID NO: 5760 - protein, 15 aa, Homo sapiens
  Heavy chain CDR3 for antibody 2880 (IGHV1-46)
SREKSHGSGTSPFDY

SEQ ID NO: 5761 - protein, 9 aa, Homo sapiens
  Light chain CDR3 for antibody 2881 (IGKV1-9)
QQLNSYPFT

SEQ ID NO: 5762 - protein, 17 aa, Homo sapiens
  Heavy chain CDR3 for antibody 2881 (IGHV3-33)
AREITMARGDNSYGMAA

SEQ ID NO: 5763 - protein, 9 aa, Homo sapiens
  Light chain CDR3 for antibody 2882 (IGKV1-9)
HQLNSYPYT

SEQ ID NO: 5764 - protein, 15 aa, Homo sapiens
  Heavy chain CDR3 for antibody 2882 (IGHV1-46)
AREKSYVSGSYPFAY

SEQ ID NO: 5765 - protein, 9 aa, Homo sapiens
  Light chain CDR3 for antibody 2883 (IGKV3D-20)
QQYGSSPWT

SEQ ID NO: 5766 - protein, 19 aa, Homo sapiens
  Heavy chain CDR3 for antibody 2883 (IGHV1-18)
ASDHGYWSSPSCYRAWFEP

SEQ ID NO: 5767 - protein, 9 aa, Homo sapiens
  Light chain CDR3 for antibody 2884 (IGKV1-9)
HQLNSYPYT

SEQ ID NO: 5768 - protein, 15 aa, Homo sapiens
  Heavy chain CDR3 for antibody 2884 (IGHV1-46)
GREKYYGSGSSPFDY

SEQ ID NO: 5769 - protein, 9 aa, Homo sapiens
  Light chain CDR3 for antibody 2885 (IGKV1-9)
HQLNSYPYT

SEQ ID NO: 5770 - protein, 15 aa, Homo sapiens
  Heavy chain CDR3 for antibody 2885 (IGHV1-46)
AREKYHVSGSYPFDY

SEQ ID NO: 5771 - protein, 9 aa, Homo sapiens
  Light chain CDR3 for antibody 2886 (IGKV1D-17)
LQHNSYPYT

SEQ ID NO: 5772 - protein, 15 aa, Homo sapiens
  Heavy chain CDR3 for antibody 2886 (IGHV1-46)
AREKYYGSGSYPFEY

SEQ ID NO: 5773 - protein, 9 aa, Homo sapiens
  Light chain CDR3 for antibody 2887 (IGKV1-9)
QHLTSHPFT

SEQ ID NO: 5774 - protein, 17 aa, Homo sapiens
  Heavy chain CDR3 for antibody 2887 (IGHV3-33)
AREITMVRGDDYYGMDV

SEQ ID NO: 5775 - protein, 9 aa, Homo sapiens
  Light chain CDR3 for antibody 2888 (IGKV1-9)
QQLNSYPYT

SEQ ID NO: 5776 - protein, 15 aa, Homo sapiens
  Heavy chain CDR3 for antibody 2888 (IGHV1-46)
AREKYYGSECYPIDY

SEQ ID NO: 5777 - protein, 9 aa, Homo sapiens
  Light chain CDR3 for antibody 2889 (IGKV1-9)
QQLNSHPFT

SEQ ID NO: 5778 - protein, 14 aa, Homo sapiens
  Heavy chain CDR3 for antibody 2889 (IGHV3-23)
AKAIAVAGTWYFDL

SEQ ID NO: 5779 - protein, 9 aa, Homo sapiens
  Light chain CDR3 for antibody 2890 (IGKV6-21)
HQSSSLPYT

SEQ ID NO: 5780 - protein, 16 aa, Homo sapiens
  Heavy chain CDR3 for antibody 2890 (IGHV1-18)
AREGDTMGRGVNALDY

SEQ ID NO: 5781 - protein, 9 aa, Homo sapiens
  Light chain CDR3 for antibody 2891 (IGKV1-9)
QQLNSYPFT

SEQ ID NO: 5782 - protein, 17 aa, Homo sapiens
  Heavy chain CDR3 for antibody 2891 (IGHV3-33)
AREITMVRVYNYYGLDV

SEQ ID NO: 5783 - protein, 9 aa, Homo sapiens
  Light chain CDR3 for antibody 2892 (IGKV1D-17)
LQHNSYPYT

SEQ ID NO: 5784 - protein, 10 aa, Homo sapiens
  Heavy chain CDR3 for antibody 2892 (IGHV3-33)
ARESSYGMDV

SEQ ID NO: 5785 - protein, 9 aa, Homo sapiens
  Light chain CDR3 for antibody 2893 (IGKV1D-17)
LQHNSYPYT

SEQ ID NO: 5786 - protein, 10 aa, Homo sapiens
  Heavy chain CDR3 for antibody 2893 (IGHV3-33)
ARDSPDGMEG

SEQ ID NO: 5787 - protein, 9 aa, Homo sapiens
  Light chain CDR3 for antibody 2894 (IGKV1-9)
QQLNSYPFT

SEQ ID NO: 5788 - protein, 17 aa, Homo sapiens
  Heavy chain CDR3 for antibody 2894 (IGHV3-33)
ARESHMVRGDNYYGMEV

SEQ ID NO: 5789 - protein, 9 aa, Homo sapiens
  Light chain CDR3 for antibody 2895 (IGKV1-9)
QQLNSYPYT

SEQ ID NO: 5790 - protein, 15 aa, Homo sapiens
  Heavy chain CDR3 for antibody 2895 (IGHV1-46)
AREKYYGAGSYPIEY

SEQ ID NO: 5791 - protein, 9 aa, Homo sapiens
  Light chain CDR3 for antibody 2896 (IGKV1-9)
QQLISYPYT

SEQ ID NO: 5792 - protein, 16 aa, Homo sapiens
  Heavy chain CDR3 for antibody 2896 (IGHV1-18)
AREGKTMGRGVIAFDY

SEQ ID NO: 5793 - protein, 9 aa, Homo sapiens
  Light chain CDR3 for antibody 2897 (IGKV1D-17)
LQHNSYPYT

SEQ ID NO: 5794 - protein, 10 aa, Homo sapiens
  Heavy chain CDR3 for antibody 2897 (IGHV3-33)
ARESPYGMAV

SEQ ID NO: 5795 - protein, 10 aa, Homo sapiens
  Light chain CDR3 for antibody 2898 (IGKV2D-28)
MQAPQTPPYT

SEQ ID NO: 5796 - protein, 15 aa, Homo sapiens
  Heavy chain CDR3 for antibody 2898 (IGHV1-46)
AREKYYGSGSYPFDY

SEQ ID NO: 5797 - protein, 9 aa, Homo sapiens
  Light chain CDR3 for antibody 2899 (IGKV1-9)
QQLNSYPFT

SEQ ID NO: 5798 - protein, 17 aa, Homo sapiens
  Heavy chain CDR3 for antibody 2899 (IGHV3-33)
GREITMVQGDNYYGLDV

SEQ ID NO: 5799 - protein, 9 aa, Homo sapiens
  Light chain CDR3 for antibody 2900 (IGKV1D-17)
LQHNSYPYT

SEQ ID NO: 5800 - protein, 10 aa, Homo sapiens
  Heavy chain CDR3 for antibody 2900 (IGHV3-33)
ARESTSGIDA

SEQ ID NO: 5801 - protein, 9 aa, Homo sapiens
  Light chain CDR3 for antibody 2901 (IGKV6-21)
HQSSSLPYT

SEQ ID NO: 5802 - protein, 16 aa, Homo sapiens
  Heavy chain CDR3 for antibody 2901 (IGHV1-18)
AREGETMVRGVIAFAS

SEQ ID NO: 5803 - protein, 9 aa, Homo sapiens
  Light chain CDR3 for antibody 2902 (IGKV1-6)
QKYNSAPLT

SEQ ID NO: 5804 - protein, 15 aa, Homo sapiens
  Heavy chain CDR3 for antibody 2902 (IGHV1-46)
AREKYYGSGSYPFDY

SEQ ID NO: 5805 - protein, 9 aa, Homo sapiens
  Light chain CDR3 for antibody 2903 (IGKV1-12)
QQANSFPRT

SEQ ID NO: 5806 - protein, 10 aa, Homo sapiens
  Heavy chain CDR3 for antibody 2903 (IGHV3-33)
ARESTDGMDV

SEQ ID NO: 5807 - protein, 9 aa, Homo sapiens
  Light chain CDR3 for antibody 2904 (IGKV1-9)
QQLISYPYT

SEQ ID NO: 5808 - protein, 15 aa, Homo sapiens
  Heavy chain CDR3 for antibody 2904 (IGHV1-46)
AREKYYGAGRYPFDS

SEQ ID NO: 5809 - protein, 9 aa, Homo sapiens
  Light chain CDR3 for antibody 2905 (IGKV1D-17)
LQHNSYPYT

SEQ ID NO: 5810 - protein, 9 aa, Homo sapiens
  Heavy chain CDR3 for antibody 2905 (IGHV3-66)
AREGAGIAY

SEQ ID NO: 5811 - protein, 9 aa, Homo sapiens
  Light chain CDR3 for antibody 2906 (IGKV1-27)
QKYNSAPLT

SEQ ID NO: 5812 - protein, 13 aa, Homo sapiens
  Heavy chain CDR3 for antibody 2906 (IGHV3-33)
ARDWCYGAGSTYY

SEQ ID NO: 5813 - protein, 9 aa, Homo sapiens
  Light chain CDR3 for antibody 2907 (IGKV1D-17)
LQHNSYPYT

SEQ ID NO: 5814 - protein, 18 aa, Homo sapiens
  Heavy chain CDR3 for antibody 2907 (IGHV3-11)
ARDRGIAAAGTYYYGMDV

SEQ ID NO: 5815 - protein, 9 aa, Homo sapiens
  Light chain CDR3 for antibody 2908 (IGKV1-9)
QQLNSYPFT

SEQ ID NO: 5816 - protein, 17 aa, Homo sapiens
  Heavy chain CDR3 for antibody 2908 (IGHV3-30)
AREITMGRGANYYAMAV

SEQ ID NO: 5817 - protein, 9 aa, Homo sapiens
  Light chain CDR3 for antibody 2909 (IGKV1-9)
HQLNSYPYT

SEQ ID NO: 5818 - protein, 15 aa, Homo sapiens
  Heavy chain CDR3 for antibody 2909 (IGHV1-46)
AREKSHGSGSSPFAS

SEQ ID NO: 5819 - protein, 9 aa, Homo sapiens
  Light chain CDR3 for antibody 2910 (IGKV1D-17)
LQHNSYPYT

SEQ ID NO: 5820 - protein, 10 aa, Homo sapiens
  Heavy chain CDR3 for antibody 2910 (IGHV3-33)
ARQSTNGIDV

SEQ ID NO: 5821 - protein, 9 aa, Homo sapiens
  Light chain CDR3 for antibody 2911 (IGKV6-21)
HQSSSLPYT

SEQ ID NO: 5822 - protein, 9 aa, Homo sapiens
  Heavy chain CDR3 for antibody 2911 (IGHV3-66)
AREGAGIDY

SEQ ID NO: 5823 - protein, 9 aa, Homo sapiens
  Light chain CDR3 for antibody 2912 (IGKV1D-17)
LQHNSYPYT

SEQ ID NO: 5824 - protein, 10 aa, Homo sapiens
  Heavy chain CDR3 for antibody 2912 (IGHV3-33)
ASESSDAMDV

SEQ ID NO: 5825 - protein, 9 aa, Homo sapiens
  Light chain CDR3 for antibody 2913 (IGKV1-9)
QQLNSYPFT

SEQ ID NO: 5826 - protein, 17 aa, Homo sapiens
  Heavy chain CDR3 for antibody 2913 (IGHV3-33)
AREITLLRGDNYYGMDF

SEQ ID NO: 5827 - protein, 9 aa, Homo sapiens
  Light chain CDR3 for antibody 2914 (IGKV1-5)
QQYNSYSRT

SEQ ID NO: 5828 - protein, 17 aa, Homo sapiens
  Heavy chain CDR3 for antibody 2914 (IGHV4-59)
ARTLFWFGESGGSSFDL

SEQ ID NO: 5829 - protein, 9 aa, Homo sapiens
  Light chain CDR3 for antibody 2915 (IGKV2D-30)
MQGTHWPIT

SEQ ID NO: 5830 - protein, 10 aa, Homo sapiens
  Heavy chain CDR3 for antibody 2915 (IGHV4-59)
AREAVAGFDY

SEQ ID NO: 5831 - protein, 9 aa, Homo sapiens
  Light chain CDR3 for antibody 2916 (IGKV1-9)
QQLNSYPFT

SEQ ID NO: 5832 - protein, 17 aa, Homo sapiens
  Heavy chain CDR3 for antibody 2916 (IGHV3-33)
ARESTMVRGDTYYGLDV

SEQ ID NO: 5833 - protein, 9 aa, Homo sapiens
  Light chain CDR3 for antibody 2917 (IGKV1-9)
QQLNSYPYT

SEQ ID NO: 5834 - protein, 10 aa, Homo sapiens
  Heavy chain CDR3 for antibody 2917 (IGHV3-33)
ARESTYAMDA

SEQ ID NO: 5835 - protein, 9 aa, Homo sapiens
  Light chain CDR3 for antibody 2918 (IGKV6-21)
HQSSSLPYT

SEQ ID NO: 5836 - protein, 16 aa, Homo sapiens
  Heavy chain CDR3 for antibody 2918 (IGHV1-18)
AREGDAMGRRVIALDY

SEQ ID NO: 5837 - protein, 9 aa, Homo sapiens
  Light chain CDR3 for antibody 2919 (IGKV1D-17)
QQLNSYPFT

SEQ ID NO: 5838 - protein, 13 aa, Homo sapiens
  Heavy chain CDR3 for antibody 2919 (IGHV1-24)
ATHYDILTGYFDY

SEQ ID NO: 5839 - protein, 9 aa, Homo sapiens
  Light chain CDR3 for antibody 2920 (IGKV1-9)
QHLNSHPFT

SEQ ID NO: 5840 - protein, 17 aa, Homo sapiens
  Heavy chain CDR3 for antibody 2920 (IGHV3-33)
AREITRVRGDNYYGLAV

SEQ ID NO: 5841 - protein, 9 aa, Homo sapiens
  Light chain CDR3 for antibody 2921 (IGKV1-9)
QQLNSYPFT

SEQ ID NO: 5842 - protein, 17 aa, Homo sapiens
  Heavy chain CDR3 for antibody 2921 (IGHV3-33)
AREITMVRVDNYYGIDD

SEQ ID NO: 5843 - protein, 9 aa, Homo sapiens
  Light chain CDR3 for antibody 2922 (IGKV1-9)
QQLISYPYT

SEQ ID NO: 5844 - protein, 15 aa, Homo sapiens
  Heavy chain CDR3 for antibody 2922 (IGHV1-46)
AREKYYGSDTYPFDS

SEQ ID NO: 5845 - protein, 9 aa, Homo sapiens
  Light chain CDR3 for antibody 2923 (IGKV3-15)
QQYNNWPRT

SEQ ID NO: 5846 - protein, 15 aa, Homo sapiens
  Heavy chain CDR3 for antibody 2923 (IGHV1-46)
AREKYYGSGSYPFDY

SEQ ID NO: 5847 - protein, 9 aa, Homo sapiens
  Light chain CDR3 for antibody 2924 (IGKV1-9)
QQLNSYPFT

SEQ ID NO: 5848 - protein, 17 aa, Homo sapiens
  Heavy chain CDR3 for antibody 2924 (IGHV3-33)
AREITMVGGDNYDGMDG

SEQ ID NO: 5849 - protein, 9 aa, Homo sapiens
  Light chain CDR3 for antibody 2925 (IGKV1D-17)
LQHNSYPYT

SEQ ID NO: 5850 - protein, 17 aa, Homo sapiens
  Heavy chain CDR3 for antibody 2925 (IGHV3-33)
ARAITMGRRDNYYGMDV

SEQ ID NO: 5851 - protein, 9 aa, Homo sapiens
  Light chain CDR3 for antibody 2926 (IGKV1-9)
LQDYNYPWT

SEQ ID NO: 5852 - protein, 18 aa, Homo sapiens
  Heavy chain CDR3 for antibody 2926 (IGHV3-33)
ARDRGIAAAGTYYYGMDV

SEQ ID NO: 5853 - protein, 9 aa, Homo sapiens
  Light chain CDR3 for antibody 2927 (IGKV1-9)
QQLNSYPFT

SEQ ID NO: 5854 - protein, 17 aa, Homo sapiens
  Heavy chain CDR3 for antibody 2927 (IGHV3-30)
AREVTMVRGDNYYALEV

SEQ ID NO: 5855 - protein, 9 aa, Homo sapiens
  Light chain CDR3 for antibody 2928 (IGKV1-9)
QQLNSHPFT

SEQ ID NO: 5856 - protein, 17 aa, Homo sapiens
  Heavy chain CDR3 for antibody 2928 (IGHV3-33)
AREINMVRGEDYYGMDV

SEQ ID NO: 5857 - protein, 9 aa, Homo sapiens
  Light chain CDR3 for antibody 2929 (IGKV1-9)
QQLNSYPYT

SEQ ID NO: 5858 - protein, 15 aa, Homo sapiens
  Heavy chain CDR3 for antibody 2929 (IGHV1-46)
AREKDYGSGSYPIDS

SEQ ID NO: 5859 - protein, 9 aa, Homo sapiens
  Light chain CDR3 for antibody 2930 (IGKV1D-17)
LQHNSYPYT

SEQ ID NO: 5860 - protein, 10 aa, Homo sapiens
  Heavy chain CDR3 for antibody 2930 (IGHV3-30)
ASASTDGIAA

SEQ ID NO: 5861 - protein, 9 aa, Homo sapiens
  Light chain CDR3 for antibody 2931 (IGKV1-9)
QQLNSYPFT

SEQ ID NO: 5862 - protein, 17 aa, Homo sapiens
  Heavy chain CDR3 for antibody 2931 (IGHV3-33)
AREITMIRGANSYGMDV

SEQ ID NO: 5863 - protein, 9 aa, Homo sapiens
  Light chain CDR3 for antibody 2932 (IGKV1-9)
QQLISYPYT

SEQ ID NO: 5864 - protein, 15 aa, Homo sapiens
  Heavy chain CDR3 for antibody 2932 (IGHV1-46)
AREKYYGYGSHPFDS

SEQ ID NO: 5865 - protein, 9 aa, Homo sapiens
  Light chain CDR3 for antibody 2933 (IGKV1-9)
QQLNSHPFT

SEQ ID NO: 5866 - protein, 10 aa, Homo sapiens
  Heavy chain CDR3 for antibody 2933 (IGHV3-33)
ARDSADGMDV

SEQ ID NO: 5867 - protein, 9 aa, Homo sapiens
  Light chain CDR3 for antibody 2934 (IGKV1-9)
QHLNSHPFT

SEQ ID NO: 5868 - protein, 17 aa, Homo sapiens
  Heavy chain CDR3 for antibody 2934 (IGHV3-33)
AREITMVRVHNYYGMDV

SEQ ID NO: 5869 - protein, 9 aa, Homo sapiens
  Light chain CDR3 for antibody 2935 (IGKV1-9)
HQLNSYPYT

SEQ ID NO: 5870 - protein, 15 aa, Homo sapiens
  Heavy chain CDR3 for antibody 2935 (IGHV1-46)
AGEKYHGSGSYPFEY

SEQ ID NO: 5871 - protein, 9 aa, Homo sapiens
  Light chain CDR3 for antibody 2936 (IGKV1D-17)
LQHNSYPYT

SEQ ID NO: 5872 - protein, 10 aa, Homo sapiens
  Heavy chain CDR3 for antibody 2936 (IGHV3-33)
AGESMAGFDY

SEQ ID NO: 5873 - protein, 9 aa, Homo sapiens
  Light chain CDR3 for antibody 2937 (IGKV3-15)
QQYNNCPRT

SEQ ID NO: 5874 - protein, 10 aa, Homo sapiens
  Heavy chain CDR3 for antibody 2937 (IGHV3-33)
ARETVAGFDY

SEQ ID NO: 5875 - protein, 9 aa, Homo sapiens
  Light chain CDR3 for antibody 2938 (IGKV1-9)
QQLNSYPFT

SEQ ID NO: 5876 - protein, 17 aa, Homo sapiens
  Heavy chain CDR3 for antibody 2938 (IGHV3-33)
AREITRVRGDNYYGMDA

SEQ ID NO: 5877 - protein, 9 aa, Homo sapiens
  Light chain CDR3 for antibody 2939 (IGKV1-9)
QQLNSYPYT

SEQ ID NO: 5878 - protein, 15 aa, Homo sapiens
  Heavy chain CDR3 for antibody 2939 (IGHV1-46)
AGEKCYGSAIYPFDY

SEQ ID NO: 5879 - protein, 9 aa, Homo sapiens
  Light chain CDR3 for antibody 2940 (IGKV1D-16)
QQYNSYPYT

SEQ ID NO: 5880 - protein, 19 aa, Homo sapiens
  Heavy chain CDR3 for antibody 2940 (IGHV1-18)
ARDHGYCSSPSCYRAWFDP

SEQ ID NO: 5881 - protein, 9 aa, Homo sapiens
  Light chain CDR3 for antibody 2941 (IGKV1D-17)
LRHNSYPYT

SEQ ID NO: 5882 - protein, 10 aa, Homo sapiens
  Heavy chain CDR3 for antibody 2941 (IGHV3-33)
ASESTDGMAV

SEQ ID NO: 5883 - protein, 9 aa, Homo sapiens
  Light chain CDR3 for antibody 2942 (IGKV1-9)
HQLNSYPYT

SEQ ID NO: 5884 - protein, 15 aa, Homo sapiens
  Heavy chain CDR3 for antibody 2942 (IGHV1-46)
AREKYHGSGSYAFEY

SEQ ID NO: 5885 - protein, 9 aa, Homo sapiens
  Light chain CDR3 for antibody 2943 (IGKV1-27)
QKFNSAPWT

SEQ ID NO: 5886 - protein, 13 aa, Homo sapiens
  Heavy chain CDR3 for antibody 2943 (IGHV3-30)
ARGSGWYNYGMDV

SEQ ID NO: 5887 - protein, 9 aa, Homo sapiens
  Light chain CDR3 for antibody 2944 (IGKV1D-17)
LQHNSYPYT

SEQ ID NO: 5888 - protein, 10 aa, Homo sapiens
  Heavy chain CDR3 for antibody 2944 (IGHV3-33)
ARYSAYGMDF

SEQ ID NO: 5889 - protein, 9 aa, Homo sapiens
  Light chain CDR3 for antibody 2945 (IGKV3D-20)
QQYGSSPLT

SEQ ID NO: 5890 - protein, 10 aa, Homo sapiens
  Heavy chain CDR3 for antibody 2945 (IGHV3-33)
AREAVAGFDY

SEQ ID NO: 5891 - protein, 9 aa, Homo sapiens
  Light chain CDR3 for antibody 2946 (IGKV1D-17)
QQLNSFPFT

SEQ ID NO: 5892 - protein, 17 aa, Homo sapiens
  Heavy chain CDR3 for antibody 2946 (IGHV3-33)
AREITMVRGENSYGIDV

SEQ ID NO: 5893 - protein, 9 aa, Homo sapiens
  Light chain CDR3 for antibody 2947 (IGKV1-9)
QQFNSYPFT

SEQ ID NO: 5894 - protein, 17 aa, Homo sapiens
  Heavy chain CDR3 for antibody 2947 (IGHV3-33)
ARESTLVRGDNYYGMDV

SEQ ID NO: 5895 - protein, 9 aa, Homo sapiens
  Light chain CDR3 for antibody 2948 (IGKV1-9)
QQLNSYPFT

SEQ ID NO: 5896 - protein, 17 aa, Homo sapiens
  Heavy chain CDR3 for antibody 2948 (IGHV3-33)
AREITMVPGDNSYGMDF

SEQ ID NO: 5897 - protein, 9 aa, Homo sapiens
  Light chain CDR3 for antibody 2949 (IGKV1-9)
QQLNSYPYT

SEQ ID NO: 5898 - protein, 10 aa, Homo sapiens
  Heavy chain CDR3 for antibody 2949 (IGHV3-33)
AREATAGMDV

SEQ ID NO: 5899 - protein, 9 aa, Homo sapiens
  Light chain CDR3 for antibody 2950 (IGKV1-9)
QQLNSYPFT

SEQ ID NO: 5900 - protein, 17 aa, Homo sapiens
  Heavy chain CDR3 for antibody 2950 (IGHV3-33)
AREIPMVRGANYYGMDV

SEQ ID NO: 5901 - protein, 9 aa, Homo sapiens
  Light chain CDR3 for antibody 2951 (IGKV1-9)
QQLISYPYT

SEQ ID NO: 5902 - protein, 15 aa, Homo sapiens
  Heavy chain CDR3 for antibody 2951 (IGHV1-46)
AREKYYGAGSYAFDS

SEQ ID NO: 5903 - protein, 9 aa, Homo sapiens
  Light chain CDR3 for antibody 2952 (IGKV1-9)
QQLNSYPFT

SEQ ID NO: 5904 - protein, 17 aa, Homo sapiens
  Heavy chain CDR3 for antibody 2952 (IGHV3-33)
TREITMIRGDNYYGMDV

SEQ ID NO: 5905 - protein, 9 aa, Homo sapiens
  Light chain CDR3 for antibody 2953 (IGKV1-9)
QQLNSYPYT

SEQ ID NO: 5906 - protein, 15 aa, Homo sapiens
  Heavy chain CDR3 for antibody 2953 (IGHV1-46)
AREKYYGSGRSPFDY

SEQ ID NO: 5907 - protein, 9 aa, Homo sapiens
  Light chain CDR3 for antibody 2954 (IGKV1D-17)
LQHNSYPYT

SEQ ID NO: 5908 - protein, 10 aa, Homo sapiens
  Heavy chain CDR3 for antibody 2954 (IGHV3-33)
ARESLAGFDY

SEQ ID NO: 5909 - protein, 9 aa, Homo sapiens
  Light chain CDR3 for antibody 2955 (IGKV1-9)
QQLNSYPFT

SEQ ID NO: 5910 - protein, 17 aa, Homo sapiens
  Heavy chain CDR3 for antibody 2955 (IGHV3-33)
AREIAMVRGDSCYGMDD

SEQ ID NO: 5911 - protein, 9 aa, Homo sapiens
  Light chain CDR3 for antibody 2956 (IGKV1-9)
QQLISYPYT

SEQ ID NO: 5912 - protein, 15 aa, Homo sapiens
  Heavy chain CDR3 for antibody 2956 (IGHV1-46)
AREKYYGSETSPFDS

SEQ ID NO: 5913 - protein, 9 aa, Homo sapiens
  Light chain CDR3 for antibody 2957 (IGKV1D-17)
LQHNSYPYT

SEQ ID NO: 5914 - protein, 13 aa, Homo sapiens
  Heavy chain CDR3 for antibody 2957 (IGHV1-24)
ATDYGDYRYSFDY

SEQ ID NO: 5915 - protein, 9 aa, Homo sapiens
  Light chain CDR3 for antibody 2958 (IGKV1-9)
QQLNSYPFT

SEQ ID NO: 5916 - protein, 17 aa, Homo sapiens
  Heavy chain CDR3 for antibody 2958 (IGHV3-33)
VREIPMVRGANYYGLDV

SEQ ID NO: 5917 - protein, 9 aa, Homo sapiens
  Light chain CDR3 for antibody 2959 (IGKV1D-17)
LQHNSYPYT

SEQ ID NO: 5918 - protein, 10 aa, Homo sapiens
  Heavy chain CDR3 for antibody 2959 (IGHV3-33)
AIKSTDGMDD

SEQ ID NO: 5919 - protein, 9 aa, Homo sapiens
  Light chain CDR3 for antibody 2960 (IGKV1-9)
QQLNSYPYT

SEQ ID NO: 5920 - protein, 10 aa, Homo sapiens
  Heavy chain CDR3 for antibody 2960 (IGHV1-46)
AREATEGFDY

SEQ ID NO: 5921 - protein, 9 aa, Homo sapiens
  Light chain CDR3 for antibody 2961 (IGKV1D-17)
LQHNSYPYT

SEQ ID NO: 5922 - protein, 10 aa, Homo sapiens
  Heavy chain CDR3 for antibody 2961 (IGHV3-33)
PIEAPTAFAY

SEQ ID NO: 5923 - protein, 9 aa, Homo sapiens
  Light chain CDR3 for antibody 2962 (IGKV1-9)
QQLNSYPYT

SEQ ID NO: 5924 - protein, 15 aa, Homo sapiens
  Heavy chain CDR3 for antibody 2962 (IGHV1-46)
VREKCYGSGSYPFDY

SEQ ID NO: 5925 - protein, 9 aa, Homo sapiens
  Light chain CDR3 for antibody 2963 (IGKV1-9)
QQLNSYPYT

SEQ ID NO: 5926 - protein, 15 aa, Homo sapiens
  Heavy chain CDR3 for antibody 2963 (IGHV1-46)
SREKSYGSGSYPFDY

SEQ ID NO: 5927 - protein, 9 aa, Homo sapiens
  Light chain CDR3 for antibody 2964 (IGKV1-9)
QQLNGYPYT

SEQ ID NO: 5928 - protein, 15 aa, Homo sapiens
  Heavy chain CDR3 for antibody 2964 (IGHV1-46)
AREKYYGSGTYPFAY

SEQ ID NO: 5929 - protein, 9 aa, Homo sapiens
  Light chain CDR3 for antibody 2965 (IGKV1-9)
QQLNSYPYT

SEQ ID NO: 5930 - protein, 15 aa, Homo sapiens
  Heavy chain CDR3 for antibody 2965 (IGHV1-46)
SREKYHGSGTYPFDY

SEQ ID NO: 5931 - protein, 9 aa, Homo sapiens
  Light chain CDR3 for antibody 2966 (IGKV1-9)
QHLNSHPFT

SEQ ID NO: 5932 - protein, 17 aa, Homo sapiens
  Heavy chain CDR3 for antibody 2966 (IGHV3-33)
AREITRVRGYNSYGMEV

SEQ ID NO: 5933 - protein, 9 aa, Homo sapiens
  Light chain CDR3 for antibody 2967 (IGKV1-9)
HQLNSYPYT

SEQ ID NO: 5934 - protein, 15 aa, Homo sapiens
  Heavy chain CDR3 for antibody 2967 (IGHV1-46)
AREKYYGSASYPIAY

SEQ ID NO: 5935 - protein, 9 aa, Homo sapiens
  Light chain CDR3 for antibody 2968 (IGKV1-9)
QQLNSYPYT

SEQ ID NO: 5936 - protein, 15 aa, Homo sapiens
  Heavy chain CDR3 for antibody 2968 (IGHV1-46)
AREKYYGAGSDPIDY

SEQ ID NO: 5937 - protein, 9 aa, Homo sapiens
  Light chain CDR3 for antibody 2969 (IGKV6-21)
HQSSSLPYT

SEQ ID NO: 5938 - protein, 16 aa, Homo sapiens
  Heavy chain CDR3 for antibody 2969 (IGHV1-18)
AREGETMVRGAIAIDY

SEQ ID NO: 5939 - protein, 9 aa, Homo sapiens
  Light chain CDR3 for antibody 2970 (IGKV1D-17)
LQHNSYPYT

SEQ ID NO: 5940 - protein, 10 aa, Homo sapiens
  Heavy chain CDR3 for antibody 2970 (IGHV3-23)
AIKSTYAIDI

SEQ ID NO: 5941 - protein, 9 aa, Homo sapiens
  Light chain CDR3 for antibody 2971 (IGKV1D-17)
LQHNSYPYT

SEQ ID NO: 5942 - protein, 15 aa, Homo sapiens
  Heavy chain CDR3 for antibody 2971 (IGHV1-46)
AREKYHGSATYPFDY

SEQ ID NO: 5943 - protein, 9 aa, Homo sapiens
  Light chain CDR3 for antibody 2972 (IGKV1-9)
QQLNSYPYT

SEQ ID NO: 5944 - protein, 15 aa, Homo sapiens
  Heavy chain CDR3 for antibody 2972 (IGHV1-46)
AREKDYGSEHYPFDY

SEQ ID NO: 5945 - protein, 9 aa, Homo sapiens
  Light chain CDR3 for antibody 2973 (IGKV1-9)
QQLNGYPYT

SEQ ID NO: 5946 - protein, 17 aa, Homo sapiens
  Heavy chain CDR3 for antibody 2973 (IGHV3-33)
AREISMARGDNYYGMDV

SEQ ID NO: 5947 - protein, 9 aa, Homo sapiens
  Light chain CDR3 for antibody 2974 (IGKV1-9)
QQLNSHPFT

SEQ ID NO: 5948 - protein, 17 aa, Homo sapiens
  Heavy chain CDR3 for antibody 2974 (IGHV3-30)
AREITMVRGHNYYAMDV

SEQ ID NO: 5949 - protein, 9 aa, Homo sapiens
  Light chain CDR3 for antibody 2975 (IGKV1-9)
QQLNSYPFT

SEQ ID NO: 5950 - protein, 15 aa, Homo sapiens
  Heavy chain CDR3 for antibody 2975 (IGHV3-33)
AREKSHGSGSYPFDY

SEQ ID NO: 5951 - protein, 9 aa, Homo sapiens
  Light chain CDR3 for antibody 2976 (IGKV1-9)
QQLNSYPFT

SEQ ID NO: 5952 - protein, 17 aa, Homo sapiens
  Heavy chain CDR3 for antibody 2976 (IGHV3-33)
ARDRGAAALYYYYGMDV

SEQ ID NO: 5953 - protein, 9 aa, Homo sapiens
  Light chain CDR3 for antibody 2977 (IGKV1D-17)
LQHNSYPYT

SEQ ID NO: 5954 - protein, 10 aa, Homo sapiens
  Heavy chain CDR3 for antibody 2977 (IGHV3-66)
ARAAMAGFDY

SEQ ID NO: 5955 - protein, 9 aa, Homo sapiens
  Light chain CDR3 for antibody 2978 (IGKV1-9)
QQLISYPYT

SEQ ID NO: 5956 - protein, 15 aa, Homo sapiens
  Heavy chain CDR3 for antibody 2978 (IGHV1-46)
AREKSYVSGSSPFDS

SEQ ID NO: 5957 - protein, 9 aa, Homo sapiens
  Light chain CDR3 for antibody 2979 (IGKV1-9)
QQLNSYPFT

SEQ ID NO: 5958 - protein, 17 aa, Homo sapiens
  Heavy chain CDR3 for antibody 2979 (IGHV3-33)
AREITMIRGDNYYGLDD

SEQ ID NO: 5959 - protein, 9 aa, Homo sapiens
  Light chain CDR3 for antibody 2980 (IGKV1D-17)
LQHNSYPYT

SEQ ID NO: 5960 - protein, 10 aa, Homo sapiens
  Heavy chain CDR3 for antibody 2980 (IGHV3-33)
AGAYTYGMDS

SEQ ID NO: 5961 - protein, 9 aa, Homo sapiens
  Light chain CDR3 for antibody 2981 (IGKV1D-17)
LQHNSYPYT

SEQ ID NO: 5962 - protein, 10 aa, Homo sapiens
  Heavy chain CDR3 for antibody 2981 (IGHV3-33)
AGASPDGMDD

SEQ ID NO: 5963 - protein, 9 aa, Homo sapiens
  Light chain CDR3 for antibody 2982 (IGKV1-9)
QQLNSYPYT

SEQ ID NO: 5964 - protein, 15 aa, Homo sapiens
  Heavy chain CDR3 for antibody 2982 (IGHV1-46)
AREKYYGSGSSPCDS

SEQ ID NO: 5965 - protein, 9 aa, Homo sapiens
  Light chain CDR3 for antibody 2983 (IGKV1D-17)
LQHNSYPWT

SEQ ID NO: 5966 - protein, 10 aa, Homo sapiens
  Heavy chain CDR3 for antibody 2983 (IGHV3-33)
TREATDGMDA

SEQ ID NO: 5967 - protein, 9 aa, Homo sapiens
  Light chain CDR3 for antibody 2984 (IGKV1-9)
QQLNSYPFT

SEQ ID NO: 5968 - protein, 17 aa, Homo sapiens
  Heavy chain CDR3 for antibody 2984 (IGHV3-33)
AREITMVRGENYYGMDD

SEQ ID NO: 5969 - protein, 9 aa, Homo sapiens
  Light chain CDR3 for antibody 2985 (IGKV1D-17)
LQHNSYPYT

SEQ ID NO: 5970 - protein, 10 aa, Homo sapiens
  Heavy chain CDR3 for antibody 2985 (IGHV3-33)
ARESVAGFDY

SEQ ID NO: 5971 - protein, 9 aa, Homo sapiens
  Light chain CDR3 for antibody 2986 (IGKV1-9)
QQLNGFPYT

SEQ ID NO: 5972 - protein, 15 aa, Homo sapiens
  Heavy chain CDR3 for antibody 2986 (IGHV1-46)
AREKYHGSGSYPFDY

SEQ ID NO: 5973 - protein, 9 aa, Homo sapiens
  Light chain CDR3 for antibody 2987 (IGKV6-21)
HQSSSLPYT

SEQ ID NO: 5974 - protein, 13 aa, Homo sapiens
  Heavy chain CDR3 for antibody 2987 (IGHV1-18)
AREGGSYYVSFDY

SEQ ID NO: 5975 - protein, 9 aa, Homo sapiens
  Light chain CDR3 for antibody 2988 (IGKV1-9)
QQLNSYPYT

SEQ ID NO: 5976 - protein, 16 aa, Homo sapiens
  Heavy chain CDR3 for antibody 2988 (IGHV1-18)
AREGDTMVRGVIAFDY

SEQ ID NO: 5977 - protein, 9 aa, Homo sapiens
  Light chain CDR3 for antibody 2989 (IGKV1D-17)
LQHNSYPYT

SEQ ID NO: 5978 - protein, 10 aa, Homo sapiens
  Heavy chain CDR3 for antibody 2989 (IGHV3-33)
AREATEGFDY

SEQ ID NO: 5979 - protein, 9 aa, Homo sapiens
  Light chain CDR3 for antibody 2990 (IGKV1-9)
QQLNSYPYT

SEQ ID NO: 5980 - protein, 17 aa, Homo sapiens
  Heavy chain CDR3 for antibody 2990 (IGHV3-33)
AREITMLRGDNYYGLDV

SEQ ID NO: 5981 - protein, 9 aa, Homo sapiens
  Light chain CDR3 for antibody 2991 (IGKV1-9)
QQLNSYPYT

SEQ ID NO: 5982 - protein, 13 aa, Homo sapiens
  Heavy chain CDR3 for antibody 2991 (IGHV3-33)
ARDYCSGDCYPDP

SEQ ID NO: 5983 - protein, 9 aa, Homo sapiens
  Light chain CDR3 for antibody 2992 (IGKV1-9)
QQLNSYPFT

SEQ ID NO: 5984 - protein, 10 aa, Homo sapiens
  Heavy chain CDR3 for antibody 2992 (IGHV3-33)
ARESVAGFDY

SEQ ID NO: 5985 - protein, 9 aa, Homo sapiens
  Light chain CDR3 for antibody 2993 (IGKV6-21)
HQSSSLPYT

SEQ ID NO: 5986 - protein, 14 aa, Homo sapiens
  Heavy chain CDR3 for antibody 2993 (IGHV1-18)
AREGYSGYIVYFDY

SEQ ID NO: 5987 - protein, 9 aa, Homo sapiens
  Light chain CDR3 for antibody 2994 (IGKV1-9)
QQLDSHPFT

SEQ ID NO: 5988 - protein, 17 aa, Homo sapiens
  Heavy chain CDR3 for antibody 2994 (IGHV3-33)
AREITMVRGDNYYGLDV

SEQ ID NO: 5989 - protein, 9 aa, Homo sapiens
  Light chain CDR3 for antibody 2995 (IGKV1-13)
QQFNSHPFT

SEQ ID NO: 5990 - protein, 17 aa, Homo sapiens
  Heavy chain CDR3 for antibody 2995 (IGHV3-33)
AREITLVRGDNYYGMDV

SEQ ID NO: 5991 - protein, 9 aa, Homo sapiens
  Light chain CDR3 for antibody 2996 (IGKV1-9)
QQFNSHPFT

SEQ ID NO: 5992 - protein, 15 aa, Homo sapiens
  Heavy chain CDR3 for antibody 2996 (IGHV1-46)
AREKYYGSGSYPFDY

SEQ ID NO: 5993 - protein, 9 aa, Homo sapiens
  Light chain CDR3 for antibody 2997 (IGKV1D-13)
QQFNNYPRT

SEQ ID NO: 5994 - protein, 16 aa, Homo sapiens
  Heavy chain CDR3 for antibody 2997 (IGHV3-33)
ARFGYSYGYDYYGMDV

SEQ ID NO: 5995 - protein, 9 aa, Homo sapiens
  Light chain CDR3 for antibody 2998 (IGKV1-17)
LQHNSYPYT

SEQ ID NO: 5996 - protein, 10 aa, Homo sapiens
  Heavy chain CDR3 for antibody 2998 (IGHV3-33)
AREGTDGFDP

SEQ ID NO: 5997 - protein, 9 aa, Homo sapiens
  Light chain CDR3 for antibody 2999 (IGKV1-9)
QQLNSHPFT

SEQ ID NO: 5998 - protein, 17 aa, Homo sapiens
  Heavy chain CDR3 for antibody 2999 (IGHV3-33)
VREISLVRGDNYYGLDV

SEQ ID NO: 5999 - protein, 9 aa, Homo sapiens
  Light chain CDR3 for antibody 3000 (IGKV6-21)
HQSSSLPYT

SEQ ID NO: 6000 - protein, 10 aa, Homo sapiens
  Heavy chain CDR3 for antibody 3000 (IGHV3-33)
ARESVAGFDY

SEQ ID NO: 6001 - protein, 9 aa, Homo sapiens
  Light chain CDR3 for antibody 3001 (IGKV1-9)
QQLNSYPLT

SEQ ID NO: 6002 - protein, 13 aa, Homo sapiens
  Heavy chain CDR3 for antibody 3001 (IGHV1-2)
ARDDYGDYDYFDF

SEQ ID NO: 6003 - protein, 9 aa, Homo sapiens
  Light chain CDR3 for antibody 3002 (IGKV1D-17)
LQHNSYPWT

SEQ ID NO: 6004 - protein, 13 aa, Homo sapiens
  Heavy chain CDR3 for antibody 3002 (IGHV3-33)
AREGPVWGMLFDI

SEQ ID NO: 6005 - protein, 9 aa, Homo sapiens
  Light chain CDR3 for antibody 3003 (IGKV6-21)
HQSSSLPYT

SEQ ID NO: 6006 - protein, 15 aa, Homo sapiens
  Heavy chain CDR3 for antibody 3003 (IGHV1-46)
AREGLTGYYPNWFDP

SEQ ID NO: 6007 - protein, 9 aa, Homo sapiens
  Light chain CDR3 for antibody 3004 (IGKV1D-16)
QQYNSYPYT

SEQ ID NO: 6008 - protein, 13 aa, Homo sapiens
  Heavy chain CDR3 for antibody 3004 (IGHV3-33)
ARDEAVAGTYFDY

SEQ ID NO: 6009 - protein, 9 aa, Homo sapiens
  Light chain CDR3 for antibody 3005 (IGKV1D-17)
LQHNTYPYT

SEQ ID NO: 6010 - protein, 10 aa, Homo sapiens
  Heavy chain CDR3 for antibody 3005 (IGHV3-33)
AREAVGGFDY

SEQ ID NO: 6011 - protein, 9 aa, Homo sapiens
  Light chain CDR3 for antibody 3006 (IGKV1-9)
QQLNGYPYT

SEQ ID NO: 6012 - protein, 15 aa, Homo sapiens
  Heavy chain CDR3 for antibody 3006 (IGHV1-46)
AREKSYGSGSYPFDY

SEQ ID NO: 6013 - protein, 9 aa, Homo sapiens
  Light chain CDR3 for antibody 3007 (IGKV1-6)
LQDYNYPWT

SEQ ID NO: 6014 - protein, 13 aa, Homo sapiens
  Heavy chain CDR3 for antibody 3007 (IGHV3-13)
ARGGWELFDAFDI

SEQ ID NO: 6015 - protein, 9 aa, Homo sapiens
  Light chain CDR3 for antibody 3008 (IGKV3-20)
QQYGSSPLT

SEQ ID NO: 6016 - protein, 13 aa, Homo sapiens
  Heavy chain CDR3 for antibody 3008 (IGHV1-18)
ARDRVLWFGECDY

SEQ ID NO: 6017 - protein, 9 aa, Homo sapiens
  Light chain CDR3 for antibody 3009 (IGKV1-9)
QQYNSYPLT

SEQ ID NO: 6018 - protein, 13 aa, Homo sapiens
  Heavy chain CDR3 for antibody 3009 (IGHV1-18)
AREGGSYYVSFDY

SEQ ID NO: 6019 - protein, 9 aa, Homo sapiens
  Light chain CDR3 for antibody 3010 (IGKV1-9)
QQLNGFPYT

SEQ ID NO: 6020 - protein, 15 aa, Homo sapiens
  Heavy chain CDR3 for antibody 3010 (IGHV1-46)
AREGLTGYYPNWFDP

SEQ ID NO: 6021 - protein, 9 aa, Homo sapiens
  Light chain CDR3 for antibody 3011 (IGKV1-9)
QQFNSYPFT

SEQ ID NO: 6022 - protein, 17 aa, Homo sapiens
  Heavy chain CDR3 for antibody 3011 (IGHV3-33)
AREITMVRGDNYYGLDV

SEQ ID NO: 6023 - protein, 9 aa, Homo sapiens
  Light chain CDR3 for antibody 3012 (IGKV1-27)
QKYNSAPWT

SEQ ID NO: 6024 - protein, 10 aa, Homo sapiens
  Heavy chain CDR3 for antibody 3012 (IGHV3-33)
AREAVAGFDY

SEQ ID NO: 6025 - protein, 9 aa, Homo sapiens
  Light chain CDR3 for antibody 3013 (IGKV1-9)
QQLNGYPYT

SEQ ID NO: 6026 - protein, 13 aa, Homo sapiens
  Heavy chain CDR3 for antibody 3013 (IGHV4-59)
ARGGSYYYYGMDV

SEQ ID NO: 6027 - protein, 9 aa, Homo sapiens
  Light chain CDR3 for antibody 3014 (IGKV1-9)
QQLNSYPFT

SEQ ID NO: 6028 - protein, 10 aa, Homo sapiens
  Heavy chain CDR3 for antibody 3014 (IGHV3-33)
AREATEGFDY

SEQ ID NO: 6029 - protein, 9 aa, Homo sapiens
  Light chain CDR3 for antibody 3015 (IGKV1-9)
QQLNSYPFT

SEQ ID NO: 6030 - protein, 12 aa, Homo sapiens
  Heavy chain CDR3 for antibody 3015 (IGHV3-23)
AKEGIAAAGLDY

SEQ ID NO: 6031 - protein, 9 aa, Homo sapiens
  Light chain CDR3 for antibody 3016 (IGKV1D-16)
QQYNSYPYT

SEQ ID NO: 6032 - protein, 12 aa, Homo sapiens
  Heavy chain CDR3 for antibody 3016 (IGHV3-33)
ARRELEGYYFDY

SEQ ID NO: 6033 - protein, 9 aa, Homo sapiens
  Light chain CDR3 for antibody 3017 (IGKV1D-13)
QQFNNYPRT

SEQ ID NO: 6034 - protein, 13 aa, Homo sapiens
  Heavy chain CDR3 for antibody 3017 (IGHV1-24)
ATDRYSGRNYFDY

SEQ ID NO: 6035 - protein, 9 aa, Homo sapiens
  Light chain CDR3 for antibody 3018 (IGKV1-9)
QQLNGYPYT

SEQ ID NO: 6036 - protein, 17 aa, Homo sapiens
  Heavy chain CDR3 for antibody 3018 (IGHV3-33)
AREITMVRGDNYYGMDV

SEQ ID NO: 6037 - protein, 9 aa, Homo sapiens
  Light chain CDR3 for antibody 3019 (IGKV1-17)
LQHNSYPLT

SEQ ID NO: 6038 - protein, 10 aa, Homo sapiens
  Heavy chain CDR3 for antibody 3019 (IGHV1-46)
ARERWELFDY

SEQ ID NO: 6039 - protein, 9 aa, Homo sapiens
  Light chain CDR3 for antibody 3020 (IGKV1-9)
QQLNGYPYT

SEQ ID NO: 6040 - protein, 15 aa, Homo sapiens
  Heavy chain CDR3 for antibody 3020 (IGHV1-46)
AREDYYGSGSYPFDS

SEQ ID NO: 6041 - protein, 9 aa, Homo sapiens
  Light chain CDR3 for antibody 3021 (IGKV1-9)
QQLNSYPWT

SEQ ID NO: 6042 - protein, 13 aa, Homo sapiens
  Heavy chain CDR3 for antibody 3021 (IGHV3-33)
AREYCGGDCYGDY

SEQ ID NO: 6043 - protein, 9 aa, Homo sapiens
  Light chain CDR3 for antibody 3022 (IGKV1-9)
QQFNSHPFT

SEQ ID NO: 6044 - protein, 16 aa, Homo sapiens
  Heavy chain CDR3 for antibody 3022 (IGHV3-33)
ARFGYSYGYDYYGMDV

SEQ ID NO: 6045 - protein, 9 aa, Homo sapiens
  Light chain CDR3 for antibody 3023 (IGKV1-9)
QQLNGYPYT

SEQ ID NO: 6046 - protein, 10 aa, Homo sapiens
  Heavy chain CDR3 for antibody 3023 (IGHV3-33)
AREAVAGFDY

SEQ ID NO: 6047 - protein, 9 aa, Homo sapiens
  Light chain CDR3 for antibody 3024 (IGKV1D-16)
QQYNSYPRT

SEQ ID NO: 6048 - protein, 16 aa, Homo sapiens
  Heavy chain CDR3 for antibody 3024 (IGHV1-46)
ARDGNPENYYYYGMDV

SEQ ID NO: 6049 - protein, 9 aa, Homo sapiens
  Light chain CDR3 for antibody 3025 (IGKV1-9)
QQFNSHPFT

SEQ ID NO: 6050 - protein, 10 aa, Homo sapiens
  Heavy chain CDR3 for antibody 3025 (IGHV3-33)
ARRVTDAFDI

SEQ ID NO: 6051 - protein, 9 aa, Homo sapiens
  Light chain CDR3 for antibody 3026 (IGKV1-9)
QQFNSHPFT

SEQ ID NO: 6052 - protein, 16 aa, Homo sapiens
  Heavy chain CDR3 for antibody 3026 (IGHV1-18)
AREGDTMVRGVIAFDY

SEQ ID NO: 6053 - protein, 9 aa, Homo sapiens
  Light chain CDR3 for antibody 3027 (IGKV1-6)
LQDYNYPYT

SEQ ID NO: 6054 - protein, 16 aa, Homo sapiens
  Heavy chain CDR3 for antibody 3027 (IGHV3-11)
ARDRGGSYDYYYGMDV

SEQ ID NO: 6055 - protein, 9 aa, Homo sapiens
  Light chain CDR3 for antibody 3028 (IGKV6-21)
HQSSSLPYT

SEQ ID NO: 6056 - protein, 16 aa, Homo sapiens
  Heavy chain CDR3 for antibody 3028 (IGHV1-69)
ATEGAVAGYYYYGMDV

SEQ ID NO: 6057 - protein, 9 aa, Homo sapiens
  Light chain CDR3 for antibody 3029 (IGKV6-21)
HQSSSLPYT

SEQ ID NO: 6058 - protein, 13 aa, Homo sapiens
  Heavy chain CDR3 for antibody 3029 (IGHV1-18)
AREGGNYIVSFDY

SEQ ID NO: 6059 - protein, 9 aa, Homo sapiens
  Light chain CDR3 for antibody 3030 (IGKV1-9)
QQLNGYPYT

SEQ ID NO: 6060 - protein, 13 aa, Homo sapiens
  Heavy chain CDR3 for antibody 3030 (IGHV1-18)
AREGGSYYVSFDY

SEQ ID NO: 6061 - protein, 9 aa, Homo sapiens
  Light chain CDR3 for antibody 3031 (IGKV1-9)
HQLISYPYT

SEQ ID NO: 6062 - protein, 15 aa, Homo sapiens
  Heavy chain CDR3 for antibody 3031 (IGHV1-46)
AREKYYGLGSYPFDC

SEQ ID NO: 6063 - protein, 9 aa, Homo sapiens
  Light chain CDR3 for antibody 3032 (IGKV1D-17)
QQLNGYPYT

SEQ ID NO: 6064 - protein, 15 aa, Homo sapiens
  Heavy chain CDR3 for antibody 3032 (IGHV1-46)
AREKYYGSGSDAFDY

SEQ ID NO: 6065 - protein, 9 aa, Homo sapiens
  Light chain CDR3 for antibody 3033 (IGKV3-11)
QQRSNWPWT

SEQ ID NO: 6066 - protein, 14 aa, Homo sapiens
  Heavy chain CDR3 for antibody 3033 (IGHV3-23)
AKDRTVAGPNWFDP

SEQ ID NO: 6067 - protein, 9 aa, Homo sapiens
  Light chain CDR3 for antibody 3034 (IGKV1D-13)
QQFNNYMYT

SEQ ID NO: 6068 - protein, 16 aa, Homo sapiens
  Heavy chain CDR3 for antibody 3034 (IGHV1-24)
ATEGAVAGYYYYGMDV

SEQ ID NO: 6069 - protein, 9 aa, Homo sapiens
  Light chain CDR3 for antibody 3035 (IGKV1-9)
QQLNSYPPT

SEQ ID NO: 6070 - protein, 14 aa, Homo sapiens
  Heavy chain CDR3 for antibody 3035 (IGHV4-59)
AREGMQLWPTAFDI

SEQ ID NO: 6071 - protein, 9 aa, Homo sapiens
  Light chain CDR3 for antibody 3036 (IGKV1D-17)
LQHNSYPWT

SEQ ID NO: 6072 - protein, 10 aa, Homo sapiens
  Heavy chain CDR3 for antibody 3036 (IGHV3-33)
ARESRSGVDY

SEQ ID NO: 6073 - protein, 8 aa, Homo sapiens
  Light chain CDR3 for antibody 3037 (IGKV3-20)
QQYGSSFT

SEQ ID NO: 6074 - protein, 11 aa, Homo sapiens
  Heavy chain CDR3 for antibody 3037 (IGHV3-33)
AAGRDYYGMDV

SEQ ID NO: 6075 - protein, 9 aa, Homo sapiens
  Light chain CDR3 for antibody 3038 (IGKV1-27)
QKYNSAPWT

SEQ ID NO: 6076 - protein, 12 aa, Homo sapiens
  Heavy chain CDR3 for antibody 3038 (IGHV1-46)
ARVMRISDAFDI

SEQ ID NO: 6077 - protein, 9 aa, Homo sapiens
  Light chain CDR3 for antibody 3039 (IGKV1-9)
HQLIGYPYT

SEQ ID NO: 6078 - protein, 15 aa, Homo sapiens
  Heavy chain CDR3 for antibody 3039 (IGHV1-46)
AREKYSGSGSYPFDY

SEQ ID NO: 6079 - protein, 9 aa, Homo sapiens
  Light chain CDR3 for antibody 3040 (IGKV1-6)
LQDYNYPFT

SEQ ID NO: 6080 - protein, 13 aa, Homo sapiens
  Heavy chain CDR3 for antibody 3040 (IGHV1-18)
AREGGSYYVSFDY

SEQ ID NO: 6081 - protein, 9 aa, Homo sapiens
  Light chain CDR3 for antibody 3041 (IGKV1-9)
QQLNSYPYT

SEQ ID NO: 6082 - protein, 14 aa, Homo sapiens
  Heavy chain CDR3 for antibody 3041 (IGHV1-18)
AREGYSGYIVYFDY

SEQ ID NO: 6083 - protein, 9 aa, Homo sapiens
  Light chain CDR3 for antibody 3042 (IGKV1-9)
QQLNGYPYT

SEQ ID NO: 6084 - protein, 15 aa, Homo sapiens
  Heavy chain CDR3 for antibody 3042 (IGHV1-46)
ARDKYYGSGTYPFDY

SEQ ID NO: 6085 - protein, 9 aa, Homo sapiens
  Light chain CDR3 for antibody 3043 (IGKV1-9)
QQLNSYPFT

SEQ ID NO: 6086 - protein, 17 aa, Homo sapiens
  Heavy chain CDR3 for antibody 3043 (IGHV3-33)
AREIALVRGDNYYGMDV

SEQ ID NO: 6087 - protein, 9 aa, Homo sapiens
  Light chain CDR3 for antibody 3044 (IGKV6-21)
HQSSSLPYT

SEQ ID NO: 6088 - protein, 16 aa, Homo sapiens
  Heavy chain CDR3 for antibody 3044 (IGHV1-46)
ARDRDIVATGEYYFDY

SEQ ID NO: 6089 - protein, 9 aa, Homo sapiens
  Light chain CDR3 for antibody 3045 (IGKV1-9)
QQLNGYPYT

SEQ ID NO: 6090 - protein, 15 aa, Homo sapiens
  Heavy chain CDR3 for antibody 3045 (IGHV1-46)
AREKDYGSGSYRFDY

SEQ ID NO: 6091 - protein, 8 aa, Homo sapiens
  Light chain CDR3 for antibody 3046 (IGKV1-5)
QQYNSYLT

SEQ ID NO: 6092 - protein, 10 aa, Homo sapiens
  Heavy chain CDR3 for antibody 3046 (IGHV3-33)
ARRVTDAFDI

SEQ ID NO: 6093 - protein, 9 aa, Homo sapiens
  Light chain CDR3 for antibody 3047 (IGKV1-27)
QKYNSAPYT

SEQ ID NO: 6094 - protein, 15 aa, Homo sapiens
  Heavy chain CDR3 for antibody 3047 (IGHV4-59)
ARERVYYGSGSYYDY

SEQ ID NO: 6095 - protein, 9 aa, Homo sapiens
  Light chain CDR3 for antibody 3048 (IGKV1-9)
QQLNSYPYT

SEQ ID NO: 6096 - protein, 15 aa, Homo sapiens
  Heavy chain CDR3 for antibody 3048 (IGHV1-46)
AREKCYGAGSDPFDY

SEQ ID NO: 6097 - protein, 9 aa, Homo sapiens
  Light chain CDR3 for antibody 3049 (IGKV1-27)
QKYNSAPPT

SEQ ID NO: 6098 - protein, 15 aa, Homo sapiens
  Heavy chain CDR3 for antibody 3049 (IGHV4-59)
ARENYGSGSLYYFDY

SEQ ID NO: 6099 - protein, 10 aa, Homo sapiens
  Light chain CDR3 for antibody 3050 (IGKV3D-20)
QQYGSSLTWT

SEQ ID NO: 6100 - protein, 15 aa, Homo sapiens
  Heavy chain CDR3 for antibody 3050 (IGHV3-20)
AREDGDSYYYYGMDV

SEQ ID NO: 6101 - protein, 9 aa, Homo sapiens
  Light chain CDR3 for antibody 3051 (IGKV1-6)
LQDYNYPWT

SEQ ID NO: 6102 - protein, 17 aa, Homo sapiens
  Heavy chain CDR3 for antibody 3051 (IGHV3-33)
AREITMVRGDNYYGMDV

SEQ ID NO: 6103 - protein, 9 aa, Homo sapiens
  Light chain CDR3 for antibody 3052 (IGKV1-9)
QQLNSYPYT

SEQ ID NO: 6104 - protein, 17 aa, Homo sapiens
  Heavy chain CDR3 for antibody 3052 (IGHV3-33)
ASEITLVRGDNYYGMDV

SEQ ID NO: 6105 - protein, 9 aa, Homo sapiens
  Light chain CDR3 for antibody 3053 (IGKV1-9)
QQLNSYPYT

SEQ ID NO: 6106 - protein, 15 aa, Homo sapiens
  Heavy chain CDR3 for antibody 3053 (IGHV1-46)
AREKYYGAGSYAFDD

SEQ ID NO: 6107 - protein, 9 aa, Homo sapiens
  Light chain CDR3 for antibody 3054 (IGKV1-17)
LQHNSYPYT

SEQ ID NO: 6108 - protein, 11 aa, Homo sapiens
  Heavy chain CDR3 for antibody 3054 (IGHV1-8)
AREGSGSYLGY

SEQ ID NO: 6109 - protein, 9 aa, Homo sapiens
  Light chain CDR3 for antibody 3055 (IGKV3-20)
QQYGSSPFT

SEQ ID NO: 6110 - protein, 16 aa, Homo sapiens
  Heavy chain CDR3 for antibody 3055 (IGHV1-24)
ATSLRYFDWLSSWFDP

SEQ ID NO: 6111 - protein, 9 aa, Homo sapiens
  Light chain CDR3 for antibody 3056 (IGKV1D-17)
LQDYNYPFT

SEQ ID NO: 6112 - protein, 10 aa, Homo sapiens
  Heavy chain CDR3 for antibody 3056 (IGHV3-33)
ARESVAGFDY

SEQ ID NO: 6113 - protein, 9 aa, Homo sapiens
  Light chain CDR3 for antibody 3057 (IGKV1-17)
LQHNSYPHT

SEQ ID NO: 6114 - protein, 16 aa, Homo sapiens
  Heavy chain CDR3 for antibody 3057 (IGHV4-61)
ARERYIAVAGTTYFDL

SEQ ID NO: 6115 - protein, 9 aa, Homo sapiens
  Light chain CDR3 for antibody 3058 (IGKV1-13)
QQSYSTPPT

SEQ ID NO: 6116 - protein, 13 aa, Homo sapiens
  Heavy chain CDR3 for antibody 3058 (IGHV4-59)
AREDYYGSGSYYY

SEQ ID NO: 6117 - protein, 9 aa, Homo sapiens
  Light chain CDR3 for antibody 3059 (IGKV1-9)
QQLNSYPYT

SEQ ID NO: 6118 - protein, 15 aa, Homo sapiens
  Heavy chain CDR3 for antibody 3059 (IGHV1-46)
ARENYYGSATYPFDY

SEQ ID NO: 6119 - protein, 9 aa, Homo sapiens
  Light chain CDR3 for antibody 3060 (IGKV1-39)
QQSYSTPYT

SEQ ID NO: 6120 - protein, 17 aa, Homo sapiens
  Heavy chain CDR3 for antibody 3060 (IGHV4-59)
AREAYYYGSGPGYGMDV

SEQ ID NO: 6121 - protein, 9 aa, Homo sapiens
  Light chain CDR3 for antibody 3061 (IGKV1D-13)
QQFNNYIFT

SEQ ID NO: 6122 - protein, 13 aa, Homo sapiens
  Heavy chain CDR3 for antibody 3061 (IGHV3-33)
ARDMVLWFGELLS

SEQ ID NO: 6123 - protein, 9 aa, Homo sapiens
  Light chain CDR3 for antibody 3062 (IGKV1-9)
QQFNSHPFT

SEQ ID NO: 6124 - protein, 10 aa, Homo sapiens
  Heavy chain CDR3 for antibody 3062 (IGHV3-33)
AREAVAGFDY

SEQ ID NO: 6125 - protein, 9 aa, Homo sapiens
  Light chain CDR3 for antibody 3063 (IGKV6-21)
HQSSSLPYT

SEQ ID NO: 6126 - protein, 13 aa, Homo sapiens
  Heavy chain CDR3 for antibody 3063 (IGHV1-18)
AREGGNYYVSIDH

SEQ ID NO: 6127 - protein, 10 aa, Homo sapiens
  Light chain CDR3 for antibody 3064 (IGKV3D-20)
QQYGSSLTWT

SEQ ID NO: 6128 - protein, 14 aa, Homo sapiens
  Heavy chain CDR3 for antibody 3064 (IGHV3-33)
ARGARYFDYYGMDV

SEQ ID NO: 6129 - protein, 9 aa, Homo sapiens
  Light chain CDR3 for antibody 3065 (IGKV1-9)
QQLNSYPFT

SEQ ID NO: 6130 - protein, 15 aa, Homo sapiens
  Heavy chain CDR3 for antibody 3065 (IGHV3-33)
AREITMVRGVIAFDY

SEQ ID NO: 6131 - protein, 9 aa, Homo sapiens
  Light chain CDR3 for antibody 3066 (IGKV1-9)
QQLNSYPYT

SEQ ID NO: 6132 - protein, 13 aa, Homo sapiens
  Heavy chain CDR3 for antibody 3066 (IGHV1-18)
AREGGNYIVSFDY

SEQ ID NO: 6133 - protein, 10 aa, Homo sapiens
  Light chain CDR3 for antibody 3067 (IGKV3-11)
QQRSNWPPWT

SEQ ID NO: 6134 - protein, 15 aa, Homo sapiens
  Heavy chain CDR3 for antibody 3067 (IGHV3-33)
ARDRAPNWGSEAFDI

SEQ ID NO: 6135 - protein, 9 aa, Homo sapiens
  Light chain CDR3 for antibody 3068 (IGKV1-9)
QQLNSYPYT

SEQ ID NO: 6136 - protein, 14 aa, Homo sapiens
  Heavy chain CDR3 for antibody 3068 (IGHV4-59)
AREDRGYYYYGMDV

SEQ ID NO: 6137 - protein, 9 aa, Homo sapiens
  Light chain CDR3 for antibody 3069 (IGKV6-21)
HQSSSLPYT

SEQ ID NO: 6138 - protein, 15 aa, Homo sapiens
  Heavy chain CDR3 for antibody 3069 (IGHV1-18)
ARDRARIAVAGNFDY

SEQ ID NO: 6139 - protein, 9 aa, Homo sapiens
  Light chain CDR3 for antibody 3070 (IGKV1-6)
LQDYNYPWT

SEQ ID NO: 6140 - protein, 18 aa, Homo sapiens
  Heavy chain CDR3 for antibody 3070 (IGHV3-11)
ARDSSSWYPYYYYYGMDV

SEQ ID NO: 6141 - protein, 9 aa, Homo sapiens
  Light chain CDR3 for antibody 3071 (IGKV1-9)
HQLNSYPYT

SEQ ID NO: 6142 - protein, 15 aa, Homo sapiens
  Heavy chain CDR3 for antibody 3071 (IGHV1-46)
AREKYDGSGSDPFDY

SEQ ID NO: 6143 - protein, 9 aa, Homo sapiens
  Light chain CDR3 for antibody 3072 (IGKV1-9)
QQLNGYPYT

SEQ ID NO: 6144 - protein, 15 aa, Homo sapiens
  Heavy chain CDR3 for antibody 3072 (IGHV1-46)
AREKCDGSGSDPFDY

SEQ ID NO: 6145 - protein, 9 aa, Homo sapiens
  Light chain CDR3 for antibody 3073 (IGKV1D-17)
LQHNSYPYT

SEQ ID NO: 6146 - protein, 16 aa, Homo sapiens
  Heavy chain CDR3 for antibody 3073 (IGHV3-33)
ARAGLLWFGELGWMDV

SEQ ID NO: 6147 - protein, 9 aa, Homo sapiens
  Light chain CDR3 for antibody 3074 (IGKV6-21)
HQSSSLPYT

SEQ ID NO: 6148 - protein, 18 aa, Homo sapiens
  Heavy chain CDR3 for antibody 3074 (IGHV1-18)
AREGDTMVRGDNYYGMDV

SEQ ID NO: 6149 - protein, 9 aa, Homo sapiens
  Light chain CDR3 for antibody 3075 (IGKV1-9)
QQLNSYPYT

SEQ ID NO: 6150 - protein, 15 aa, Homo sapiens
  Heavy chain CDR3 for antibody 3075 (IGHV1-46)
AREKYYGSGTSPFDY

SEQ ID NO: 6151 - protein, 9 aa, Homo sapiens
  Light chain CDR3 for antibody 3076 (IGKV1-9)
QQLNGYPYT

SEQ ID NO: 6152 - protein, 15 aa, Homo sapiens
  Heavy chain CDR3 for antibody 3076 (IGHV1-46)
SREKYYGSGSYPFDY

SEQ ID NO: 6153 - protein, 9 aa, Homo sapiens
  Light chain CDR3 for antibody 3077 (IGKV1-9)
QQLNSYPYT

SEQ ID NO: 6154 - protein, 15 aa, Homo sapiens
  Heavy chain CDR3 for antibody 3077 (IGHV1-46)
AREKYYGAGSYPLDY

SEQ ID NO: 6155 - protein, 9 aa, Homo sapiens
  Light chain CDR3 for antibody 3078 (IGKV1-9)
QQLNSYPYT

SEQ ID NO: 6156 - protein, 11 aa, Homo sapiens
  Heavy chain CDR3 for antibody 3078 (IGHV3-33)
AREWQWLAPDY

SEQ ID NO: 6157 - protein, 9 aa, Homo sapiens
  Light chain CDR3 for antibody 3079 (IGKV1-39)
QQSFITPYT

SEQ ID NO: 6158 - protein, 20 aa, Homo sapiens
  Heavy chain CDR3 for antibody 3079 (IGHV4-59)
ARDRGSGSPPHYYYYYGMDV

SEQ ID NO: 6159 - protein, 9 aa, Homo sapiens
  Light chain CDR3 for antibody 3080 (IGKV1-9)
HQLNSYPYT

SEQ ID NO: 6160 - protein, 15 aa, Homo sapiens
  Heavy chain CDR3 for antibody 3080 (IGHV1-46)
AREKCYGSGSYAFDY

SEQ ID NO: 6161 - protein, 9 aa, Homo sapiens
  Light chain CDR3 for antibody 3081 (IGKV1-9)
QQFNSYPFT

SEQ ID NO: 6162 - protein, 10 aa, Homo sapiens
  Heavy chain CDR3 for antibody 3081 (IGHV3-33)
AREGTDGFDP

SEQ ID NO: 6163 - protein, 9 aa, Homo sapiens
  Light chain CDR3 for antibody 3082 (IGKV1-9)
QQFNSHPFT

SEQ ID NO: 6164 - protein, 15 aa, Homo sapiens
  Heavy chain CDR3 for antibody 3082 (IGHV1-46)
AREGLTGYYPNWFDP

SEQ ID NO: 6165 - protein, 9 aa, Homo sapiens
  Light chain CDR3 for antibody 3083 (IGKV1-9)
QQLNSYPYT

SEQ ID NO: 6166 - protein, 5 aa, Homo sapiens
  Heavy chain CDR3 for antibody 3083 (IGHV1-46)
AREKY

SEQ ID NO: 6167 - protein, 9 aa, Homo sapiens
  Light chain CDR3 for antibody 3084 (IGKV1D-17)
LQHNSYPYT

SEQ ID NO: 6168 - protein, 15 aa, Homo sapiens
  Heavy chain CDR3 for antibody 3084 (IGHV1-46)
AREGLTGYYPNWFDP

SEQ ID NO: 6169 - protein, 9 aa, Homo sapiens
  Light chain CDR3 for antibody 3085 (IGKV1-17)
LQHNSYPYT

SEQ ID NO: 6170 - protein, 15 aa, Homo sapiens
  Heavy chain CDR3 for antibody 3085 (IGHV4-59)
AREERYSGYDAGMDV

SEQ ID NO: 6171 - protein, 9 aa, Homo sapiens
  Light chain CDR3 for antibody 3086 (IGKV3-20)
QQYGSSPLT

SEQ ID NO: 6172 - protein, 15 aa, Homo sapiens
  Heavy chain CDR3 for antibody 3086 (IGHV1-46)
AREKYYGSGSYPFDY

SEQ ID NO: 6173 - protein, 9 aa, Homo sapiens
  Light chain CDR3 for antibody 3087 (IGKV1-9)
QQLNGYPYT

SEQ ID NO: 6174 - protein, 12 aa, Homo sapiens
  Heavy chain CDR3 for antibody 3087 (IGHV1-46)
ARGEAAAGHFDY

SEQ ID NO: 6175 - protein, 9 aa, Homo sapiens
  Light chain CDR3 for antibody 3088 (IGKV1-6)
LQDYNYPRT

SEQ ID NO: 6176 - protein, 9 aa, Homo sapiens
  Heavy chain CDR3 for antibody 3088 (IGHV1-46)
ARGPVAPSV

SEQ ID NO: 6177 - protein, 9 aa, Homo sapiens
  Light chain CDR3 for antibody 3089 (IGKV1-27)
QKYNSAPWT

SEQ ID NO: 6178 - protein, 15 aa, Homo sapiens
  Heavy chain CDR3 for antibody 3089 (IGHV1-46)
AREKYYGSGSYPFDY

SEQ ID NO: 6179 - protein, 9 aa, Homo sapiens
  Light chain CDR3 for antibody 3090 (IGKV1D-17)
LQHNSYPYT

SEQ ID NO: 6180 - protein, 13 aa, Homo sapiens
  Heavy chain CDR3 for antibody 3090 (IGHV3-33)
AREYCGGDCYGDY

SEQ ID NO: 6181 - protein, 9 aa, Homo sapiens
  Light chain CDR3 for antibody 3091 (IGKV1-9)
QQLNGYPYT

SEQ ID NO: 6182 - protein, 15 aa, Homo sapiens
  Heavy chain CDR3 for antibody 3091 (IGHV1-46)
AREKYYGSARYPFDY

SEQ ID NO: 6183 - protein, 9 aa, Homo sapiens
  Light chain CDR3 for antibody 3092 (IGKV6-21)
HQSSSLPYT

SEQ ID NO: 6184 - protein, 19 aa, Homo sapiens
  Heavy chain CDR3 for antibody 3092 (IGHV4-59)
AREVRDILTGYNYYYGMDV

SEQ ID NO: 6185 - protein, 9 aa, Homo sapiens
  Light chain CDR3 for antibody 3093 (IGKV1-9)
QQLNSYPLT

SEQ ID NO: 6186 - protein, 15 aa, Homo sapiens
  Heavy chain CDR3 for antibody 3093 (IGHV1-46)
ARENYYGSGSYPFDY

SEQ ID NO: 6187 - protein, 9 aa, Homo sapiens
  Light chain CDR3 for antibody 3094 (IGKV1-9)
QQLNSHPFT

SEQ ID NO: 6188 - protein, 17 aa, Homo sapiens
  Heavy chain CDR3 for antibody 3094 (IGHV3-33)
AREITMVRGDNYYGVDV

SEQ ID NO: 6189 - protein, 9 aa, Homo sapiens
  Light chain CDR3 for antibody 3095 (IGKV1D-13)
QQFNNYPRT

SEQ ID NO: 6190 - protein, 15 aa, Homo sapiens
  Heavy chain CDR3 for antibody 3095 (IGHV1-46)
AREKYYGSGSYPFDY

SEQ ID NO: 6191 - protein, 9 aa, Homo sapiens
  Light chain CDR3 for antibody 3096 (IGKV1-9)
QQLNSYPLT

SEQ ID NO: 6192 - protein, 17 aa, Homo sapiens
  Heavy chain CDR3 for antibody 3096 (IGHV3-33)
ARDPYDILTGYYYGMDV

SEQ ID NO: 6193 - protein, 9 aa, Homo sapiens
  Light chain CDR3 for antibody 3097 (IGKV1-9)
QQLNSYPFT

SEQ ID NO: 6194 - protein, 17 aa, Homo sapiens
  Heavy chain CDR3 for antibody 3097 (IGHV3-33)
ARELTMLRGDNYYGLDV

SEQ ID NO: 6195 - protein, 9 aa, Homo sapiens
  Light chain CDR3 for antibody 3098 (IGKV1-6)
LQDYNYPYT

SEQ ID NO: 6196 - protein, 13 aa, Homo sapiens
  Heavy chain CDR3 for antibody 3098 (IGHV1-24)
ATGDGSGSYRGDY

SEQ ID NO: 6197 - protein, 9 aa, Homo sapiens
  Light chain CDR3 for antibody 3099 (IGKV1-9)
QQLNSYPFT

SEQ ID NO: 6198 - protein, 17 aa, Homo sapiens
  Heavy chain CDR3 for antibody 3099 (IGHV3-33)
AREITMVRGDNYYGIDF

SEQ ID NO: 6199 - protein, 9 aa, Homo sapiens
  Light chain CDR3 for antibody 3100 (IGKV1-9)
QQLNSYPYT

SEQ ID NO: 6200 - protein, 17 aa, Homo sapiens
  Heavy chain CDR3 for antibody 3100 (IGHV3-33)
AREITMVRVDNYYGIDV

SEQ ID NO: 6201 - protein, 9 aa, Homo sapiens
  Light chain CDR3 for antibody 3101 (IGKV2D-28)
MQALQTPYT

SEQ ID NO: 6202 - protein, 20 aa, Homo sapiens
  Heavy chain CDR3 for antibody 3101 (IGHV4-59)
ARERSYGSGSYRYYYYGMDV

SEQ ID NO: 6203 - protein, 9 aa, Homo sapiens
  Light chain CDR3 for antibody 3102 (IGKV1-9)
QQLNSYPFT

SEQ ID NO: 6204 - protein, 13 aa, Homo sapiens
  Heavy chain CDR3 for antibody 3102 (IGHV3-33)
AREGPVWGMLFDI

SEQ ID NO: 6205 - protein, 9 aa, Homo sapiens
  Light chain CDR3 for antibody 3103 (IGKV1D-13)
QQFNNYPRT

SEQ ID NO: 6206 - protein, 10 aa, Homo sapiens
  Heavy chain CDR3 for antibody 3103 (IGHV3-33)
ARESVAGFDY

SEQ ID NO: 6207 - protein, 9 aa, Homo sapiens
  Light chain CDR3 for antibody 3104 (IGKV6-21)
HQSSSLPYT

SEQ ID NO: 6208 - protein, 16 aa, Homo sapiens
  Heavy chain CDR3 for antibody 3104 (IGHV1-18)
AREGDTMVRGVIAFAS

SEQ ID NO: 6209 - protein, 9 aa, Homo sapiens
  Light chain CDR3 for antibody 3105 (IGKV1-9)
QQLNSYPFT

SEQ ID NO: 6210 - protein, 17 aa, Homo sapiens
  Heavy chain CDR3 for antibody 3105 (IGHV3-33)
ARESTLVRGDNYYGLDV

SEQ ID NO: 6211 - protein, 9 aa, Homo sapiens
  Light chain CDR3 for antibody 3106 (IGKV1-9)
QQLNSYPYT

SEQ ID NO: 6212 - protein, 15 aa, Homo sapiens
  Heavy chain CDR3 for antibody 3106 (IGHV1-46)
AREKYYGAGSYPIDS

SEQ ID NO: 6213 - protein, 9 aa, Homo sapiens
  Light chain CDR3 for antibody 3107 (IGKV1-9)
QQLNSYPLT

SEQ ID NO: 6214 - protein, 15 aa, Homo sapiens
  Heavy chain CDR3 for antibody 3107 (IGHV1-46)
AREKYYGAGSYPFDY

SEQ ID NO: 6215 - protein, 9 aa, Homo sapiens
  Light chain CDR3 for antibody 3108 (IGKV1-9)
QQLNGYPYT

SEQ ID NO: 6216 - protein, 15 aa, Homo sapiens
  Heavy chain CDR3 for antibody 3108 (IGHV1-46)
ARENYYGSGSYPFDY

SEQ ID NO: 6217 - protein, 9 aa, Homo sapiens
  Light chain CDR3 for antibody 3109 (IGKV1-8)
QQYYSYPYT

SEQ ID NO: 6218 - protein, 17 aa, Homo sapiens
  Heavy chain CDR3 for antibody 3109 (IGHV3-33)
AREITMVRGDNYYGMDV

SEQ ID NO: 6219 - protein, 9 aa, Homo sapiens
  Light chain CDR3 for antibody 3110 (IGKV1-9)
QQLNSYPYT

SEQ ID NO: 6220 - protein, 15 aa, Homo sapiens
  Heavy chain CDR3 for antibody 3110 (IGHV1-46)
AREKYYGSGSYPFAS

SEQ ID NO: 6221 - protein, 9 aa, Homo sapiens
  Light chain CDR3 for antibody 3111 (IGKV3D-7)
QQDYNLPYT

SEQ ID NO: 6222 - protein, 15 aa, Homo sapiens
  Heavy chain CDR3 for antibody 3111 (IGHV3-33)
ARSPTVTSYYYGMDV

SEQ ID NO: 6223 - protein, 9 aa, Homo sapiens
  Light chain CDR3 for antibody 3112 (IGKV1-9)
QHLNSHPFT

SEQ ID NO: 6224 - protein, 17 aa, Homo sapiens
  Heavy chain CDR3 for antibody 3112 (IGHV3-33)
AREITMLRGDNYYGLDV

SEQ ID NO: 6225 - protein, 9 aa, Homo sapiens
  Light chain CDR3 for antibody 3113 (IGKV1D-16)
QQYNSYPRT

SEQ ID NO: 6226 - protein, 15 aa, Homo sapiens
  Heavy chain CDR3 for antibody 3113 (IGHV4-59)
ARERVYYGSGSYYDY

SEQ ID NO: 6227 - protein, 9 aa, Homo sapiens
  Light chain CDR3 for antibody 3114 (IGKV1-6)
LQDYNYPYT

SEQ ID NO: 6228 - protein, 17 aa, Homo sapiens
  Heavy chain CDR3 for antibody 3114 (IGHV3-33)
ARDRATVTLYYYYGMDV

SEQ ID NO: 6229 - protein, 9 aa, Homo sapiens
  Light chain CDR3 for antibody 3115 (IGKV1-9)
QQLNSYPYT

SEQ ID NO: 6230 - protein, 13 aa, Homo sapiens
  Heavy chain CDR3 for antibody 3115 (IGHV3-33)
ARVQLERRLAFDI

SEQ ID NO: 6231 - protein, 9 aa, Homo sapiens
  Light chain CDR3 for antibody 3116 (IGKV1-9)
LQDYNYPRT

SEQ ID NO: 6232 - protein, 17 aa, Homo sapiens
  Heavy chain CDR3 for antibody 3116 (IGHV3-33)
AREITMLRGDNYYGLDV

SEQ ID NO: 6233 - protein, 9 aa, Homo sapiens
  Light chain CDR3 for antibody 3117 (IGKV1-9)
QQLNSYPFT

SEQ ID NO: 6234 - protein, 13 aa, Homo sapiens
  Heavy chain CDR3 for antibody 3117 (IGHV1-18)
AREGGSFYVSFDY

SEQ ID NO: 6235 - protein, 9 aa, Homo sapiens
  Light chain CDR3 for antibody 3118 (IGKV1-9)
QQFNSYPFT

SEQ ID NO: 6236 - protein, 17 aa, Homo sapiens
  Heavy chain CDR3 for antibody 3118 (IGHV3-33)
AREITMVRGDNHYGMDV

SEQ ID NO: 6237 - protein, 9 aa, Homo sapiens
  Light chain CDR3 for antibody 3119 (IGKV1-9)
QQLNSYPYT

SEQ ID NO: 6238 - protein, 15 aa, Homo sapiens
  Heavy chain CDR3 for antibody 3119 (IGHV1-46)
AREKSYGSGSYPIDY

SEQ ID NO: 6239 - protein, 9 aa, Homo sapiens
  Light chain CDR3 for antibody 3120 (IGKV1-9)
QQLNSYPYT

SEQ ID NO: 6240 - protein, 17 aa, Homo sapiens
  Heavy chain CDR3 for antibody 3120 (IGHV3-33)
ARESTMARGDNYYGMDV

SEQ ID NO: 6241 - protein, 9 aa, Homo sapiens
  Light chain CDR3 for antibody 3121 (IGKV6-21)
HQSSSLPYT

SEQ ID NO: 6242 - protein, 14 aa, Homo sapiens
  Heavy chain CDR3 for antibody 3121 (IGHV1-18)
AREGYSGYLVSFDS

SEQ ID NO: 6243 - protein, 9 aa, Homo sapiens
  Light chain CDR3 for antibody 3122 (IGKV1-9)
QQLNSYPYT

SEQ ID NO: 6244 - protein, 15 aa, Homo sapiens
  Heavy chain CDR3 for antibody 3122 (IGHV1-46)
AIEKYYGSGTYPFDY

SEQ ID NO: 6245 - protein, 9 aa, Homo sapiens
  Light chain CDR3 for antibody 3123 (IGKV1D-16)
QQYNSYPRT

SEQ ID NO: 6246 - protein, 15 aa, Homo sapiens
  Heavy chain CDR3 for antibody 3123 (IGHV1-46)
AREKYYGSGSYPFDY

SEQ ID NO: 6247 - protein, 9 aa, Homo sapiens
  Light chain CDR3 for antibody 3124 (IGKV1-9)
QHLNSYPFT

SEQ ID NO: 6248 - protein, 17 aa, Homo sapiens
  Heavy chain CDR3 for antibody 3124 (IGHV3-33)
ARESTMVRGDNYDGMDV

SEQ ID NO: 6249 - protein, 9 aa, Homo sapiens
  Light chain CDR3 for antibody 3125 (IGKV6-21)
HQSSSLPYT

SEQ ID NO: 6250 - protein, 15 aa, Homo sapiens
  Heavy chain CDR3 for antibody 3125 (IGHV1-18)
AREGDIVATIIAFDI

SEQ ID NO: 6251 - protein, 9 aa, Homo sapiens
  Light chain CDR3 for antibody 3126 (IGKV1-9)
QQLNGFPYT

SEQ ID NO: 6252 - protein, 10 aa, Homo sapiens
  Heavy chain CDR3 for antibody 3126 (IGHV3-33)
ARESTDGMDV

SEQ ID NO: 6253 - protein, 9 aa, Homo sapiens
  Light chain CDR3 for antibody 3127 (IGKV1-17)
QQFNSHPFT

SEQ ID NO: 6254 - protein, 17 aa, Homo sapiens
  Heavy chain CDR3 for antibody 3127 (IGHV3-33)
AREIAMVRGDNYYGLDG

SEQ ID NO: 6255 - protein, 9 aa, Homo sapiens
  Light chain CDR3 for antibody 3128 (IGKV1-9)
QQLNSYPYT

SEQ ID NO: 6256 - protein, 15 aa, Homo sapiens
  Heavy chain CDR3 for antibody 3128 (IGHV1-46)
AREKCDGSGSYPFDY

SEQ ID NO: 6257 - protein, 9 aa, Homo sapiens
  Light chain CDR3 for antibody 3129 (IGKV1D-16)
QQYNSYPRT

SEQ ID NO: 6258 - protein, 11 aa, Homo sapiens
  Heavy chain CDR3 for antibody 3129 (IGHV1-8)
AREGSGSYLGY

SEQ ID NO: 6259 - protein, 9 aa, Homo sapiens
  Light chain CDR3 for antibody 3130 (IGKV1-9)
QQLNSYPFT

SEQ ID NO: 6260 - protein, 17 aa, Homo sapiens
  Heavy chain CDR3 for antibody 3130 (IGHV3-33)
AREITLIRGDNYYGIDV

SEQ ID NO: 6261 - protein, 9 aa, Homo sapiens
  Light chain CDR3 for antibody 3131 (IGKV6-21)
HQSSSLPYT

SEQ ID NO: 6262 - protein, 16 aa, Homo sapiens
  Heavy chain CDR3 for antibody 3131 (IGHV1-18)
AREGDTMVRGGNAFDS

SEQ ID NO: 6263 - protein, 9 aa, Homo sapiens
  Light chain CDR3 for antibody 3132 (IGKV1-9)
HQLNSYPYT

SEQ ID NO: 6264 - protein, 15 aa, Homo sapiens
  Heavy chain CDR3 for antibody 3132 (IGHV1-46)
AREKYYVSGSYPFDY

SEQ ID NO: 6265 - protein, 9 aa, Homo sapiens
  Light chain CDR3 for antibody 3133 (IGKV1-9)
QQLNSYPYT

SEQ ID NO: 6266 - protein, 13 aa, Homo sapiens
  Heavy chain CDR3 for antibody 3133 (IGHV3-33)
ARDYCGGDYYLDP

SEQ ID NO: 6267 - protein, 9 aa, Homo sapiens
  Light chain CDR3 for antibody 3134 (IGKV1D-17)
LQHTSYPYT

SEQ ID NO: 6268 - protein, 10 aa, Homo sapiens
  Heavy chain CDR3 for antibody 3134 (IGHV3-33)
SREALAGFDY

SEQ ID NO: 6269 - protein, 9 aa, Homo sapiens
  Light chain CDR3 for antibody 3135 (IGKV6-21)
HQSSSLPYT

SEQ ID NO: 6270 - protein, 16 aa, Homo sapiens
  Heavy chain CDR3 for antibody 3135 (IGHV1-18)
AREEDTMVPGVIAFYY

SEQ ID NO: 6271 - protein, 9 aa, Homo sapiens
  Light chain CDR3 for antibody 3136 (IGKV1-9)
QQLNSYPYT

SEQ ID NO: 6272 - protein, 17 aa, Homo sapiens
  Heavy chain CDR3 for antibody 3136 (IGHV1-46)
ARDGLLWFGELLSWFDP

SEQ ID NO: 6273 - protein, 9 aa, Homo sapiens
  Light chain CDR3 for antibody 3137 (IGKV1D-17)
QQLNSYPLT

SEQ ID NO: 6274 - protein, 15 aa, Homo sapiens
  Heavy chain CDR3 for antibody 3137 (IGHV1-46)
AREVYYGSGSYPFDY

SEQ ID NO: 6275 - protein, 9 aa, Homo sapiens
  Light chain CDR3 for antibody 3138 (IGKV3-20)
QQYGSSPLT

SEQ ID NO: 6276 - protein, 17 aa, Homo sapiens
  Heavy chain CDR3 for antibody 3138 (IGHV3-33)
AREITMVRGDNYYGMDV

SEQ ID NO: 6277 - protein, 9 aa, Homo sapiens
  Light chain CDR3 for antibody 3139 (IGKV1D-17)
LQHNSYPYT

SEQ ID NO: 6278 - protein, 13 aa, Homo sapiens
  Heavy chain CDR3 for antibody 3139 (IGHV1-18)
AREGGSYYVSFDY

SEQ ID NO: 6279 - protein, 9 aa, Homo sapiens
  Light chain CDR3 for antibody 3140 (IGKV1-9)
QQFNSHPFT

SEQ ID NO: 6280 - protein, 17 aa, Homo sapiens
  Heavy chain CDR3 for antibody 3140 (IGHV3-33)
AREITMIRGDNYDGMDF

SEQ ID NO: 6281 - protein, 9 aa, Homo sapiens
  Light chain CDR3 for antibody 3141 (IGKV1-9)
QQLNSYPYT

SEQ ID NO: 6282 - protein, 15 aa, Homo sapiens
  Heavy chain CDR3 for antibody 3141 (IGHV1-46)
AREKFHGSGSYPFDS

SEQ ID NO: 6283 - protein, 9 aa, Homo sapiens
  Light chain CDR3 for antibody 3142 (IGKV1-9)
QQLNSYPYT

SEQ ID NO: 6284 - protein, 15 aa, Homo sapiens
  Heavy chain CDR3 for antibody 3142 (IGHV1-46)
AREKYYGSDTYPFDY

SEQ ID NO: 6285 - protein, 9 aa, Homo sapiens
  Light chain CDR3 for antibody 3143 (IGKV1-6)
LQDYNCPHT

SEQ ID NO: 6286 - protein, 16 aa, Homo sapiens
  Heavy chain CDR3 for antibody 3143 (IGHV3-33)
ARREDRDYYYYYGMDV

SEQ ID NO: 6287 - protein, 9 aa, Homo sapiens
  Light chain CDR3 for antibody 3144 (IGKV1-9)
QQLNSYPYT

SEQ ID NO: 6288 - protein, 15 aa, Homo sapiens
  Heavy chain CDR3 for antibody 3144 (IGHV1-46)
SREKYYGSGTYPFAY

SEQ ID NO: 6289 - protein, 9 aa, Homo sapiens
  Light chain CDR3 for antibody 3145 (IGKV1-9)
QQLNSYPYT

SEQ ID NO: 6290 - protein, 15 aa, Homo sapiens
  Heavy chain CDR3 for antibody 3145 (IGHV1-46)
AREGLTGYYPNGFDA

SEQ ID NO: 6291 - protein, 9 aa, Homo sapiens
  Light chain CDR3 for antibody 3146 (IGKV1D-17)
LQHTSYPYT

SEQ ID NO: 6292 - protein, 10 aa, Homo sapiens
  Heavy chain CDR3 for antibody 3146 (IGHV3-33)
AREAVAGFDY

SEQ ID NO: 6293 - protein, 9 aa, Homo sapiens
  Light chain CDR3 for antibody 3147 (IGKV1-9)
QQLNGYPYT

SEQ ID NO: 6294 - protein, 15 aa, Homo sapiens
  Heavy chain CDR3 for antibody 3147 (IGHV1-46)
AREKYYGSGNYPFDY

SEQ ID NO: 6295 - protein, 9 aa, Homo sapiens
  Light chain CDR3 for antibody 3148 (IGKV1-9)
QQLNGYPYT

SEQ ID NO: 6296 - protein, 15 aa, Homo sapiens
  Heavy chain CDR3 for antibody 3148 (IGHV1-46)
AREKCYGAGSYPFDA

SEQ ID NO: 6297 - protein, 9 aa, Homo sapiens
  Light chain CDR3 for antibody 3149 (IGKV1-9)
QQLNSYPYT

SEQ ID NO: 6298 - protein, 10 aa, Homo sapiens
  Heavy chain CDR3 for antibody 3149 (IGHV1-46)
ARERWELFDY

SEQ ID NO: 6299 - protein, 9 aa, Homo sapiens
  Light chain CDR3 for antibody 3150 (IGKV1-9)
QQLNGYPYT

SEQ ID NO: 6300 - protein, 15 aa, Homo sapiens
  Heavy chain CDR3 for antibody 3150 (IGHV1-46)
ARENYYGSGSSPFDY

SEQ ID NO: 6301 - protein, 9 aa, Homo sapiens
  Light chain CDR3 for antibody 3151 (IGKV1-9)
QQLTSYPYT

SEQ ID NO: 6302 - protein, 17 aa, Homo sapiens
  Heavy chain CDR3 for antibody 3151 (IGHV3-33)
AREITMVRGDNYYGMDV

SEQ ID NO: 6303 - protein, 9 aa, Homo sapiens
  Light chain CDR3 for antibody 3152 (IGKV1-17)
LQHNSYPYT

SEQ ID NO: 6304 - protein, 17 aa, Homo sapiens
  Heavy chain CDR3 for antibody 3152 (IGHV3-33)
ARDYDILGYYYYYGMDV

SEQ ID NO: 6305 - protein, 9 aa, Homo sapiens
  Light chain CDR3 for antibody 3153 (IGKV1-9)
QQLNGFPYT

SEQ ID NO: 6306 - protein, 16 aa, Homo sapiens
  Heavy chain CDR3 for antibody 3153 (IGHV1-18)
AREGDTMVRGVIAFDF

SEQ ID NO: 6307 - protein, 9 aa, Homo sapiens
  Light chain CDR3 for antibody 3154 (IGKV1D-16)
QQYNSYPLT

SEQ ID NO: 6308 - protein, 15 aa, Homo sapiens
  Heavy chain CDR3 for antibody 3154 (IGHV4-39)
ARGAYYYDSGSPEDY

SEQ ID NO: 6309 - protein, 9 aa, Homo sapiens
  Light chain CDR3 for antibody 3155 (IGKV1-9)
QQLNGYPYT

SEQ ID NO: 6310 - protein, 15 aa, Homo sapiens
  Heavy chain CDR3 for antibody 3155 (IGHV1-46)
AREKSYVSGSYPFDY

SEQ ID NO: 6311 - protein, 9 aa, Homo sapiens
  Light chain CDR3 for antibody 3156 (IGKV6-21)
HQSSSLPYT

SEQ ID NO: 6312 - protein, 16 aa, Homo sapiens
  Heavy chain CDR3 for antibody 3156 (IGHV1-18)
AGEGDTMGRGVNAFDY

SEQ ID NO: 6313 - protein, 9 aa, Homo sapiens
  Light chain CDR3 for antibody 3157 (IGKV1-13)
QQYNSYPLT

SEQ ID NO: 6314 - protein, 20 aa, Homo sapiens
  Heavy chain CDR3 for antibody 3157 (IGHV3-11)
ARERGYYYGSVGDYYYGMDV

SEQ ID NO: 6315 - protein, 9 aa, Homo sapiens
  Light chain CDR3 for antibody 3158 (IGKV6-21)
HQSSSLPYT

SEQ ID NO: 6316 - protein, 13 aa, Homo sapiens
  Heavy chain CDR3 for antibody 3158 (IGHV4-59)
ARGGSYYYYGMDV

SEQ ID NO: 6317 - protein, 9 aa, Homo sapiens
  Light chain CDR3 for antibody 3159 (IGKV1-9)
QQLNSYPFT

SEQ ID NO: 6318 - protein, 17 aa, Homo sapiens
  Heavy chain CDR3 for antibody 3159 (IGHV3-48)
AREINMFRGDNSYGMDV

SEQ ID NO: 6319 - protein, 9 aa, Homo sapiens
  Light chain CDR3 for antibody 3160 (IGKV1-9)
QQLNGYPYT

SEQ ID NO: 6320 - protein, 16 aa, Homo sapiens
  Heavy chain CDR3 for antibody 3160 (IGHV3-33)
ARFGYSYGYDYYGMDV

SEQ ID NO: 6321 - protein, 9 aa, Homo sapiens
  Light chain CDR3 for antibody 3161 (IGKV1-9)
LQHNSHPFT

SEQ ID NO: 6322 - protein, 17 aa, Homo sapiens
  Heavy chain CDR3 for antibody 3161 (IGHV3-33)
AREITMVRGDNYYGLDV

SEQ ID NO: 6323 - protein, 9 aa, Homo sapiens
  Light chain CDR3 for antibody 3162 (IGKV1-9)
QQLNSYPFT

SEQ ID NO: 6324 - protein, 17 aa, Homo sapiens
  Heavy chain CDR3 for antibody 3162 (IGHV3-33)
AREITKFRGDSYYGMDV

SEQ ID NO: 6325 - protein, 9 aa, Homo sapiens
  Light chain CDR3 for antibody 3163 (IGKV1-9)
QQLNSYPYT

SEQ ID NO: 6326 - protein, 17 aa, Homo sapiens
  Heavy chain CDR3 for antibody 3163 (IGHV3-33)
AREITMVRGDNYYGMDA

SEQ ID NO: 6327 - protein, 9 aa, Homo sapiens
  Light chain CDR3 for antibody 3164 (IGKV6-21)
HQSSSLPYT

SEQ ID NO: 6328 - protein, 16 aa, Homo sapiens
  Heavy chain CDR3 for antibody 3164 (IGHV1-18)
AREGDTRVRGVIAFYS

SEQ ID NO: 6329 - protein, 9 aa, Homo sapiens
  Light chain CDR3 for antibody 3165 (IGKV1-9)
QQLNSYPYT

SEQ ID NO: 6330 - protein, 15 aa, Homo sapiens
  Heavy chain CDR3 for antibody 3165 (IGHV1-46)
AIYKYYGSDTYPFDY

SEQ ID NO: 6331 - protein, 9 aa, Homo sapiens
  Light chain CDR3 for antibody 3166 (IGKV1-9)
QQLDSHPFT

SEQ ID NO: 6332 - protein, 15 aa, Homo sapiens
  Heavy chain CDR3 for antibody 3166 (IGHV1-46)
AREKYHGSGSYPFDY

SEQ ID NO: 6333 - protein, 9 aa, Homo sapiens
  Light chain CDR3 for antibody 3167 (IGKV1-9)
QQLNGFPYT

SEQ ID NO: 6334 - protein, 15 aa, Homo sapiens
  Heavy chain CDR3 for antibody 3167 (IGHV1-46)
AREKSQGSGSYPFAY

SEQ ID NO: 6335 - protein, 9 aa, Homo sapiens
  Light chain CDR3 for antibody 3168 (IGKV1-9)
QQLNSYPLT

SEQ ID NO: 6336 - protein, 15 aa, Homo sapiens
  Heavy chain CDR3 for antibody 3168 (IGHV1-46)
AREKYYGSGSYPIEY

SEQ ID NO: 6337 - protein, 9 aa, Homo sapiens
  Light chain CDR3 for antibody 3169 (IGKV1-9)
QQLNSHPFT

SEQ ID NO: 6338 - protein, 17 aa, Homo sapiens
  Heavy chain CDR3 for antibody 3169 (IGHV3-33)
ARESTMVRGDNYYGLDS

SEQ ID NO: 6339 - protein, 9 aa, Homo sapiens
  Light chain CDR3 for antibody 3170 (IGKV1-9)
QQLNSYPYT

SEQ ID NO: 6340 - protein, 15 aa, Homo sapiens
  Heavy chain CDR3 for antibody 3170 (IGHV1-46)
SREKYYVSASYPFDY

SEQ ID NO: 6341 - protein, 9 aa, Homo sapiens
  Light chain CDR3 for antibody 3171 (IGKV1-9)
QQLNSYPFT

SEQ ID NO: 6342 - protein, 17 aa, Homo sapiens
  Heavy chain CDR3 for antibody 3171 (IGHV3-33)
AREITMVRGYNYYGIDA

SEQ ID NO: 6343 - protein, 9 aa, Homo sapiens
  Light chain CDR3 for antibody 3172 (IGKV6-21)
HQSSSLPYT

SEQ ID NO: 6344 - protein, 16 aa, Homo sapiens
  Heavy chain CDR3 for antibody 3172 (IGHV1-18)
AREGDTMVRGVIAIAY

SEQ ID NO: 6345 - protein, 9 aa, Homo sapiens
  Light chain CDR3 for antibody 3173 (IGKV1-9)
QQLNSYPFT

SEQ ID NO: 6346 - protein, 17 aa, Homo sapiens
  Heavy chain CDR3 for antibody 3173 (IGHV3-33)
ARESTRVRGDNYYGMDV

SEQ ID NO: 6347 - protein, 9 aa, Homo sapiens
  Light chain CDR3 for antibody 3174 (IGKV6-21)
HQSSSLPYT

SEQ ID NO: 6348 - protein, 10 aa, Homo sapiens
  Heavy chain CDR3 for antibody 3174 (IGHV3-33)
AREATEGFDY

SEQ ID NO: 6349 - protein, 9 aa, Homo sapiens
  Light chain CDR3 for antibody 3175 (IGKV1-12)
QQANSFPWT

SEQ ID NO: 6350 - protein, 19 aa, Homo sapiens
  Heavy chain CDR3 for antibody 3175 (IGHV1-18)
ARDHGYCSSTSCYRAWFDH

SEQ ID NO: 6351 - protein, 9 aa, Homo sapiens
  Light chain CDR3 for antibody 3176 (IGKV1-6)
LQDYNYPWT

SEQ ID NO: 6352 - protein, 20 aa, Homo sapiens
  Heavy chain CDR3 for antibody 3176 (IGHV3-48)
ARERYCDWLLGGSGSSGMDV

SEQ ID NO: 6353 - protein, 9 aa, Homo sapiens
  Light chain CDR3 for antibody 3177 (IGKV1-9)
QQLNSYPYT

SEQ ID NO: 6354 - protein, 12 aa, Homo sapiens
  Heavy chain CDR3 for antibody 3177 (IGHV3-33)
ARESVAGTEFDY

SEQ ID NO: 6355 - protein, 9 aa, Homo sapiens
  Light chain CDR3 for antibody 3178 (IGKV1-9)
QHLNSYPFT

SEQ ID NO: 6356 - protein, 15 aa, Homo sapiens
  Heavy chain CDR3 for antibody 3178 (IGHV3-33)
AREKYYGSGSYPFDY

SEQ ID NO: 6357 - protein, 9 aa, Homo sapiens
  Light chain CDR3 for antibody 3179 (IGKV1-9)
QQFNSHPFT

SEQ ID NO: 6358 - protein, 17 aa, Homo sapiens
  Heavy chain CDR3 for antibody 3179 (IGHV3-33)
AREITMVRGDNYDGMDD

SEQ ID NO: 6359 - protein, 9 aa, Homo sapiens
  Light chain CDR3 for antibody 3180 (IGKV1-9)
QQLNSYPFT

SEQ ID NO: 6360 - protein, 17 aa, Homo sapiens
  Heavy chain CDR3 for antibody 3180 (IGHV3-33)
AREITLVRGDNYYGLDV

SEQ ID NO: 6361 - protein, 9 aa, Homo sapiens
  Light chain CDR3 for antibody 3181 (IGKV6-21)
HQSSSLPYT

SEQ ID NO: 6362 - protein, 16 aa, Homo sapiens
  Heavy chain CDR3 for antibody 3181 (IGHV1-18)
AREGDTMGQGAIAFDY

SEQ ID NO: 6363 - protein, 9 aa, Homo sapiens
  Light chain CDR3 for antibody 3182 (IGKV3-20)
QQYGSSPLT

SEQ ID NO: 6364 - protein, 16 aa, Homo sapiens
  Heavy chain CDR3 for antibody 3182 (IGHV1-18)
AREGDTMVRGVIAFDY

SEQ ID NO: 6365 - protein, 9 aa, Homo sapiens
  Light chain CDR3 for antibody 3183 (IGKV1-9)
QQLNGYPYT

SEQ ID NO: 6366 - protein, 15 aa, Homo sapiens
  Heavy chain CDR3 for antibody 3183 (IGHV1-46)
AREKYDGSGSYPFEY

SEQ ID NO: 6367 - protein, 9 aa, Homo sapiens
  Light chain CDR3 for antibody 3184 (IGKV1D-17)
LQHNSYPYT

SEQ ID NO: 6368 - protein, 13 aa, Homo sapiens
  Heavy chain CDR3 for antibody 3184 (IGHV3-53)
ARDYCGGDCYPDP

SEQ ID NO: 6369 - protein, 9 aa, Homo sapiens
  Light chain CDR3 for antibody 3185 (IGKV6-21)
HQSSSLPYT

SEQ ID NO: 6370 - protein, 16 aa, Homo sapiens
  Heavy chain CDR3 for antibody 3185 (IGHV1-18)
AREGDTMVPAFIAFDY

SEQ ID NO: 6371 - protein, 9 aa, Homo sapiens
  Light chain CDR3 for antibody 3186 (IGKV1D-17)
LQHNSYPYT

SEQ ID NO: 6372 - protein, 10 aa, Homo sapiens
  Heavy chain CDR3 for antibody 3186 (IGHV3-33)
AREAVAGFDC

SEQ ID NO: 6373 - protein, 9 aa, Homo sapiens
  Light chain CDR3 for antibody 3187 (IGKV1-9)
QQLNSYPYT

SEQ ID NO: 6374 - protein, 15 aa, Homo sapiens
  Heavy chain CDR3 for antibody 3187 (IGHV1-46)
AREKDYGSGSYPIDY

SEQ ID NO: 6375 - protein, 9 aa, Homo sapiens
  Light chain CDR3 for antibody 3188 (IGKV1-9)
QQLNSYPFT

SEQ ID NO: 6376 - protein, 17 aa, Homo sapiens
  Heavy chain CDR3 for antibody 3188 (IGHV3-33)
ASEITVVRGDNYYGMDV

SEQ ID NO: 6377 - protein, 9 aa, Homo sapiens
  Light chain CDR3 for antibody 3189 (IGKV1-9)
QQFNSHPFT

SEQ ID NO: 6378 - protein, 17 aa, Homo sapiens
  Heavy chain CDR3 for antibody 3189 (IGHV3-33)
AREITMVRGYNYYGFDV

SEQ ID NO: 6379 - protein, 9 aa, Homo sapiens
  Light chain CDR3 for antibody 3190 (IGKV1-9)
QQLNSYPYT

SEQ ID NO: 6380 - protein, 15 aa, Homo sapiens
  Heavy chain CDR3 for antibody 3190 (IGHV1-46)
AREKFSGSGSYPFAY

SEQ ID NO: 6381 - protein, 9 aa, Homo sapiens
  Light chain CDR3 for antibody 3191 (IGKV1D-17)
LQHNSYPYT

SEQ ID NO: 6382 - protein, 10 aa, Homo sapiens
  Heavy chain CDR3 for antibody 3191 (IGHV3-33)
ARDAAAGFDY

SEQ ID NO: 6383 - protein, 9 aa, Homo sapiens
  Light chain CDR3 for antibody 3192 (IGKV1-9)
QQFNSYPFI

SEQ ID NO: 6384 - protein, 17 aa, Homo sapiens
  Heavy chain CDR3 for antibody 3192 (IGHV3-30)
AREITILRGDNYYALDV

SEQ ID NO: 6385 - protein, 9 aa, Homo sapiens
  Light chain CDR3 for antibody 3193 (IGKV1-9)
QQLNSYPFT

SEQ ID NO: 6386 - protein, 17 aa, Homo sapiens
  Heavy chain CDR3 for antibody 3193 (IGHV3-33)
ARAIAMFRGDNYYGMDV

SEQ ID NO: 6387 - protein, 9 aa, Homo sapiens
  Light chain CDR3 for antibody 3194 (IGKV1-9)
QQLNSYPYT

SEQ ID NO: 6388 - protein, 15 aa, Homo sapiens
  Heavy chain CDR3 for antibody 3194 (IGHV1-46)
ARAKFHGSGSYPFDY

SEQ ID NO: 6389 - protein, 9 aa, Homo sapiens
  Light chain CDR3 for antibody 3195 (IGKV6-21)
HQSSSLPYT

SEQ ID NO: 6390 - protein, 13 aa, Homo sapiens
  Heavy chain CDR3 for antibody 3195 (IGHV1-18)
ARDRVLGFGECDY

SEQ ID NO: 6391 - protein, 9 aa, Homo sapiens
  Light chain CDR3 for antibody 3196 (IGKV1D-17)
LQHNSYPYT

SEQ ID NO: 6392 - protein, 15 aa, Homo sapiens
  Heavy chain CDR3 for antibody 3196 (IGHV1-46)
AREKYYGAGSDPFDY

SEQ ID NO: 6393 - protein, 9 aa, Homo sapiens
  Light chain CDR3 for antibody 3197 (IGKV3D-7)
QQDYNYPYT

SEQ ID NO: 6394 - protein, 15 aa, Homo sapiens
  Heavy chain CDR3 for antibody 3197 (IGHV1-46)
AREKYYGSGSYPFDY

SEQ ID NO: 6395 - protein, 9 aa, Homo sapiens
  Light chain CDR3 for antibody 3198 (IGKV1-9)
QQLNSYPYT

SEQ ID NO: 6396 - protein, 15 aa, Homo sapiens
  Heavy chain CDR3 for antibody 3198 (IGHV1-46)
ERAKYYGSGSYPFDY

SEQ ID NO: 6397 - protein, 9 aa, Homo sapiens
  Light chain CDR3 for antibody 3199 (IGKV1-9)
QQLNSYPYT

SEQ ID NO: 6398 - protein, 16 aa, Homo sapiens
  Heavy chain CDR3 for antibody 3199 (IGHV3-11)
ARDRGGSYDYYYGMDV

SEQ ID NO: 6399 - protein, 9 aa, Homo sapiens
  Light chain CDR3 for antibody 3200 (IGKV1-6)
LQDYNYPWT

SEQ ID NO: 6400 - protein, 14 aa, Homo sapiens
  Heavy chain CDR3 for antibody 3200 (IGHV3-33)
AREITMVRADAFDI

SEQ ID NO: 6401 - protein, 9 aa, Homo sapiens
  Light chain CDR3 for antibody 3201 (IGKV1-9)
QQLNSYPST

SEQ ID NO: 6402 - protein, 17 aa, Homo sapiens
  Heavy chain CDR3 for antibody 3201 (IGHV3-33)
AREVTMVRGDNYDGMDV

SEQ ID NO: 6403 - protein, 9 aa, Homo sapiens
  Light chain CDR3 for antibody 3202 (IGKV1-9)
QQLNSYPYT

SEQ ID NO: 6404 - protein, 17 aa, Homo sapiens
  Heavy chain CDR3 for antibody 3202 (IGHV3-33)
SREITMVRGDNYYGMDV

SEQ ID NO: 6405 - protein, 9 aa, Homo sapiens
  Light chain CDR3 for antibody 3203 (IGKV1-9)
QQLNSYPFT

SEQ ID NO: 6406 - protein, 17 aa, Homo sapiens
  Heavy chain CDR3 for antibody 3203 (IGHV3-23)
AREIAMVRGDNYYGIDV

SEQ ID NO: 6407 - protein, 9 aa, Homo sapiens
  Light chain CDR3 for antibody 3204 (IGKV1-9)
QQLNSYPFT

SEQ ID NO: 6408 - protein, 17 aa, Homo sapiens
  Heavy chain CDR3 for antibody 3204 (IGHV3-33)
AREITKFRGDNYYGLAV

SEQ ID NO: 6409 - protein, 9 aa, Homo sapiens
  Light chain CDR3 for antibody 3205 (IGKV1-9)
QQLNSYPYT

SEQ ID NO: 6410 - protein, 15 aa, Homo sapiens
  Heavy chain CDR3 for antibody 3205 (IGHV1-46)
AREKSYGPGSYPCDY

SEQ ID NO: 6411 - protein, 9 aa, Homo sapiens
  Light chain CDR3 for antibody 3206 (IGKV1-9)
QQLNSYPFT

SEQ ID NO: 6412 - protein, 17 aa, Homo sapiens
  Heavy chain CDR3 for antibody 3206 (IGHV3-33)
AREITMVRGDNSYGMDA

SEQ ID NO: 6413 - protein, 9 aa, Homo sapiens
  Light chain CDR3 for antibody 3207 (IGKV1-9)
QQLNSYPFT

SEQ ID NO: 6414 - protein, 17 aa, Homo sapiens
  Heavy chain CDR3 for antibody 3207 (IGHV3-33)
ARQITMVWGYNYYGIDV

SEQ ID NO: 6415 - protein, 9 aa, Homo sapiens
  Light chain CDR3 for antibody 3208 (IGKV1-9)
QQFNSYPFT

SEQ ID NO: 6416 - protein, 17 aa, Homo sapiens
  Heavy chain CDR3 for antibody 3208 (IGHV3-33)
GREISMVRGDNYYGMDV

SEQ ID NO: 6417 - protein, 9 aa, Homo sapiens
  Light chain CDR3 for antibody 3209 (IGKV1-9)
QQLNSYQYT

SEQ ID NO: 6418 - protein, 15 aa, Homo sapiens
  Heavy chain CDR3 for antibody 3209 (IGHV1-46)
AREKSYGSASYPFDS

SEQ ID NO: 6419 - protein, 9 aa, Homo sapiens
  Light chain CDR3 for antibody 3210 (IGKV1-9)
QQLNSYPYT

SEQ ID NO: 6420 - protein, 15 aa, Homo sapiens
  Heavy chain CDR3 for antibody 3210 (IGHV1-46)
AREKYHGSGYYPIDY

SEQ ID NO: 6421 - protein, 9 aa, Homo sapiens
  Light chain CDR3 for antibody 3211 (IGKV1-9)
QQLNGYPYT

SEQ ID NO: 6422 - protein, 15 aa, Homo sapiens
  Heavy chain CDR3 for antibody 3211 (IGHV1-46)
AREKYYGAGSYPLDY

SEQ ID NO: 6423 - protein, 9 aa, Homo sapiens
  Light chain CDR3 for antibody 3212 (IGKV1-9)
QQLNSYPYT

SEQ ID NO: 6424 - protein, 17 aa, Homo sapiens
  Heavy chain CDR3 for antibody 3212 (IGHV3-30)
AREITMVRGDTYNGMDD

SEQ ID NO: 6425 - protein, 9 aa, Homo sapiens
  Light chain CDR3 for antibody 3213 (IGKV1-9)
QHLNSYPFT

SEQ ID NO: 6426 - protein, 17 aa, Homo sapiens
  Heavy chain CDR3 for antibody 3213 (IGHV3-33)
AREITMVRGDNYYGIDD

SEQ ID NO: 6427 - protein, 9 aa, Homo sapiens
  Light chain CDR3 for antibody 3214 (IGKV1-6)
LQDYNYPWT

SEQ ID NO: 6428 - protein, 15 aa, Homo sapiens
  Heavy chain CDR3 for antibody 3214 (IGHV1-46)
ARDLVVVPAAMGFDY

SEQ ID NO: 6429 - protein, 9 aa, Homo sapiens
  Light chain CDR3 for antibody 3215 (IGKV1-9)
QQLNGYPYT

SEQ ID NO: 6430 - protein, 17 aa, Homo sapiens
  Heavy chain CDR3 for antibody 3215 (IGHV3-33)
AREIALVRGDNYYGMDV

SEQ ID NO: 6431 - protein, 9 aa, Homo sapiens
  Light chain CDR3 for antibody 3216 (IGKV1-9)
QQLNSYPYT

SEQ ID NO: 6432 - protein, 15 aa, Homo sapiens
  Heavy chain CDR3 for antibody 3216 (IGHV1-46)
AREKYYGSGCYPFDF

SEQ ID NO: 6433 - protein, 9 aa, Homo sapiens
  Light chain CDR3 for antibody 3217 (IGKV1-9)
QQLNSYPFT

SEQ ID NO: 6434 - protein, 13 aa, Homo sapiens
  Heavy chain CDR3 for antibody 3217 (IGHV3-13)
ARGGWELFDAFDI

SEQ ID NO: 6435 - protein, 9 aa, Homo sapiens
  Light chain CDR3 for antibody 3218 (IGKV6-21)
HQSSSLPYT

SEQ ID NO: 6436 - protein, 15 aa, Homo sapiens
  Heavy chain CDR3 for antibody 3218 (IGHV1-46)
AREIFTGYYPNCFDP

SEQ ID NO: 6437 - protein, 9 aa, Homo sapiens
  Light chain CDR3 for antibody 3219 (IGKV6-21)
HQSSSLPYT

SEQ ID NO: 6438 - protein, 16 aa, Homo sapiens
  Heavy chain CDR3 for antibody 3219 (IGHV1-18)
GREGDTMGRGGIAFDY

SEQ ID NO: 6439 - protein, 9 aa, Homo sapiens
  Light chain CDR3 for antibody 3220 (IGKV1-9)
QQLNGYPYT

SEQ ID NO: 6440 - protein, 15 aa, Homo sapiens
  Heavy chain CDR3 for antibody 3220 (IGHV1-46)
AREKSYGSGSYPFAS

SEQ ID NO: 6441 - protein, 9 aa, Homo sapiens
  Light chain CDR3 for antibody 3221 (IGKV1-9)
QQLNSYPYT

SEQ ID NO: 6442 - protein, 15 aa, Homo sapiens
  Heavy chain CDR3 for antibody 3221 (IGHV1-46)
AREKCYGSGSYPLDY

SEQ ID NO: 6443 - protein, 9 aa, Homo sapiens
  Light chain CDR3 for antibody 3222 (IGKV6-21)
HQSSSLPYT

SEQ ID NO: 6444 - protein, 16 aa, Homo sapiens
  Heavy chain CDR3 for antibody 3222 (IGHV1-18)
ARKGNTMVQGIIAFDY

SEQ ID NO: 6445 - protein, 9 aa, Homo sapiens
  Light chain CDR3 for antibody 3223 (IGKV1-9)
QQLNSYPFT

SEQ ID NO: 6446 - protein, 17 aa, Homo sapiens
  Heavy chain CDR3 for antibody 3223 (IGHV3-30)
AREITLVRGDNYYAMDL

SEQ ID NO: 6447 - protein, 9 aa, Homo sapiens
  Light chain CDR3 for antibody 3224 (IGKV1-9)
QQLNGYPYT

SEQ ID NO: 6448 - protein, 15 aa, Homo sapiens
  Heavy chain CDR3 for antibody 3224 (IGHV1-46)
AREKSSGSGIYPFDY

SEQ ID NO: 6449 - protein, 9 aa, Homo sapiens
  Light chain CDR3 for antibody 3225 (IGKV1-9)
QQLNSYPYT

SEQ ID NO: 6450 - protein, 15 aa, Homo sapiens
  Heavy chain CDR3 for antibody 3225 (IGHV1-46)
ARDKYYGSGIYPFDY

SEQ ID NO: 6451 - protein, 9 aa, Homo sapiens
  Light chain CDR3 for antibody 3226 (IGKV6-21)
HQSSSLPYT

SEQ ID NO: 6452 - protein, 13 aa, Homo sapiens
  Heavy chain CDR3 for antibody 3226 (IGHV1-18)
ARECGSYYVAIDY

SEQ ID NO: 6453 - protein, 9 aa, Homo sapiens
  Light chain CDR3 for antibody 3227 (IGKV1-9)
QQLSSYPYT

SEQ ID NO: 6454 - protein, 15 aa, Homo sapiens
  Heavy chain CDR3 for antibody 3227 (IGHV1-46)
AREKYYGSWSYPIDY

SEQ ID NO: 6455 - protein, 9 aa, Homo sapiens
  Light chain CDR3 for antibody 3228 (IGKV1D-17)
QQLNGYPYT

SEQ ID NO: 6456 - protein, 10 aa, Homo sapiens
  Heavy chain CDR3 for antibody 3228 (IGHV3-33)
AREATEGFDY

SEQ ID NO: 6457 - protein, 9 aa, Homo sapiens
  Light chain CDR3 for antibody 3229 (IGKV1-9)
HQLNSYPYT

SEQ ID NO: 6458 - protein, 15 aa, Homo sapiens
  Heavy chain CDR3 for antibody 3229 (IGHV1-46)
AREKSYGSGSYPFAY

SEQ ID NO: 6459 - protein, 9 aa, Homo sapiens
  Light chain CDR3 for antibody 3230 (IGKV1-9)
QQLNSYPYT

SEQ ID NO: 6460 - protein, 13 aa, Homo sapiens
  Heavy chain CDR3 for antibody 3230 (IGHV1-18)
ARDRVRWFGECDY

SEQ ID NO: 6461 - protein, 9 aa, Homo sapiens
  Light chain CDR3 for antibody 3231 (IGKV1-9)
QQLNGFPYT

SEQ ID NO: 6462 - protein, 15 aa, Homo sapiens
  Heavy chain CDR3 for antibody 3231 (IGHV1-46)
AIEKYYGAGSYPIDY

SEQ ID NO: 6463 - protein, 9 aa, Homo sapiens
  Light chain CDR3 for antibody 3232 (IGKV6-21)
HQSSSLPYT

SEQ ID NO: 6464 - protein, 16 aa, Homo sapiens
  Heavy chain CDR3 for antibody 3232 (IGHV1-69)
AREGETMGRGVIAFDC

SEQ ID NO: 6465 - protein, 9 aa, Homo sapiens
  Light chain CDR3 for antibody 3233 (IGKV1-9)
QQFNSYPFT

SEQ ID NO: 6466 - protein, 17 aa, Homo sapiens
  Heavy chain CDR3 for antibody 3233 (IGHV3-33)
AREIAMVRGDSYYGLDV

SEQ ID NO: 6467 - protein, 9 aa, Homo sapiens
  Light chain CDR3 for antibody 3234 (IGKV1-16)
QQYNSYPYT

SEQ ID NO: 6468 - protein, 12 aa, Homo sapiens
  Heavy chain CDR3 for antibody 3234 (IGHV3-33)
ASSSNWADAFDI

SEQ ID NO: 6469 - protein, 9 aa, Homo sapiens
  Light chain CDR3 for antibody 3235 (IGKV1-9)
QQLNGYPYT

SEQ ID NO: 6470 - protein, 15 aa, Homo sapiens
  Heavy chain CDR3 for antibody 3235 (IGHV1-46)
AREKFYGSGSYPFAY

SEQ ID NO: 6471 - protein, 9 aa, Homo sapiens
  Light chain CDR3 for antibody 3236 (IGKV1-9)
QQLNSYPFT

SEQ ID NO: 6472 - protein, 17 aa, Homo sapiens
  Heavy chain CDR3 for antibody 3236 (IGHV3-33)
VREITMLRGDDYYGLDV

SEQ ID NO: 6473 - protein, 9 aa, Homo sapiens
  Light chain CDR3 for antibody 3237 (IGKV1-9)
QQINGYPYT

SEQ ID NO: 6474 - protein, 15 aa, Homo sapiens
  Heavy chain CDR3 for antibody 3237 (IGHV1-46)
ARKKYYGSWSYPFDY

SEQ ID NO: 6475 - protein, 9 aa, Homo sapiens
  Light chain CDR3 for antibody 3238 (IGKV1-9)
QQLNSYPFT

SEQ ID NO: 6476 - protein, 17 aa, Homo sapiens
  Heavy chain CDR3 for antibody 3238 (IGHV3-33)
AREITMVRGDDYSGMDF

SEQ ID NO: 6477 - protein, 9 aa, Homo sapiens
  Light chain CDR3 for antibody 3239 (IGKV1-9)
QQLNSYPYT

SEQ ID NO: 6478 - protein, 15 aa, Homo sapiens
  Heavy chain CDR3 for antibody 3239 (IGHV1-46)
AGEKYYGSGSYPFDS

SEQ ID NO: 6479 - protein, 9 aa, Homo sapiens
  Light chain CDR3 for antibody 3240 (IGKV6-21)
HQSSSLPYT

SEQ ID NO: 6480 - protein, 16 aa, Homo sapiens
  Heavy chain CDR3 for antibody 3240 (IGHV1-18)
SRERNTMVRGIIAFDY

SEQ ID NO: 6481 - protein, 9 aa, Homo sapiens
  Light chain CDR3 for antibody 3241 (IGKV1-9)
QQFNSYPFI

SEQ ID NO: 6482 - protein, 17 aa, Homo sapiens
  Heavy chain CDR3 for antibody 3241 (IGHV3-33)
AREITMIRGDNYYGMDV

SEQ ID NO: 6483 - protein, 9 aa, Homo sapiens
  Light chain CDR3 for antibody 3242 (IGKV1-9)
QQLNSYPYT

SEQ ID NO: 6484 - protein, 15 aa, Homo sapiens
  Heavy chain CDR3 for antibody 3242 (IGHV1-46)
ARENYYGSVSYPFDY

SEQ ID NO: 6485 - protein, 9 aa, Homo sapiens
  Light chain CDR3 for antibody 3243 (IGKV1-6)
LQDYNYPRT

SEQ ID NO: 6486 - protein, 16 aa, Homo sapiens
  Heavy chain CDR3 for antibody 3243 (IGHV3-33)
ARDSSGWYAYYYGMDV

SEQ ID NO: 6487 - protein, 9 aa, Homo sapiens
  Light chain CDR3 for antibody 3244 (IGKV1-9)
QQFNSYPFT

SEQ ID NO: 6488 - protein, 17 aa, Homo sapiens
  Heavy chain CDR3 for antibody 3244 (IGHV3-33)
AREITMVRGENYYGMDD

SEQ ID NO: 6489 - protein, 9 aa, Homo sapiens
  Light chain CDR3 for antibody 3245 (IGKV1-9)
QQLNSYPLT

SEQ ID NO: 6490 - protein, 15 aa, Homo sapiens
  Heavy chain CDR3 for antibody 3245 (IGHV1-46)
AREKYYGSGSYPFAD

SEQ ID NO: 6491 - protein, 9 aa, Homo sapiens
  Light chain CDR3 for antibody 3246 (IGKV1-9)
QQLNSYPLT

SEQ ID NO: 6492 - protein, 13 aa, Homo sapiens
  Heavy chain CDR3 for antibody 3246 (IGHV3-33)
ARDYCGGDCYTDP

SEQ ID NO: 6493 - protein, 9 aa, Homo sapiens
  Light chain CDR3 for antibody 3247 (IGKV1-9)
QQLNSHPFT

SEQ ID NO: 6494 - protein, 13 aa, Homo sapiens
  Heavy chain CDR3 for antibody 3247 (IGHV3-33)
ARDYCGGDCYPDP

SEQ ID NO: 6495 - protein, 9 aa, Homo sapiens
  Light chain CDR3 for antibody 3248 (IGKV1-9)
QQLNSYPYT

SEQ ID NO: 6496 - protein, 15 aa, Homo sapiens
  Heavy chain CDR3 for antibody 3248 (IGHV1-46)
AGEKYYSAGSDPFDY

SEQ ID NO: 6497 - protein, 9 aa, Homo sapiens
  Light chain CDR3 for antibody 3249 (IGKV1-9)
QQLNGFPYT

SEQ ID NO: 6498 - protein, 15 aa, Homo sapiens
  Heavy chain CDR3 for antibody 3249 (IGHV1-46)
AREKYYGSGSYPFEY

SEQ ID NO: 6499 - protein, 9 aa, Homo sapiens
  Light chain CDR3 for antibody 3250 (IGKV6-21)
HQSSSLPYT

SEQ ID NO: 6500 - protein, 16 aa, Homo sapiens
  Heavy chain CDR3 for antibody 3250 (IGHV1-18)
SREEETIVPGVIAFDY

SEQ ID NO: 6501 - protein, 9 aa, Homo sapiens
  Light chain CDR3 for antibody 3251 (IGKV1-9)
QQLNGYPYT

SEQ ID NO: 6502 - protein, 16 aa, Homo sapiens
  Heavy chain CDR3 for antibody 3251 (IGHV1-18)
SREGYTMVRGVIAFDY

SEQ ID NO: 6503 - protein, 9 aa, Homo sapiens
  Light chain CDR3 for antibody 3252 (IGKV1-9)
QQLNSYPYT

SEQ ID NO: 6504 - protein, 15 aa, Homo sapiens
  Heavy chain CDR3 for antibody 3252 (IGHV1-46)
AREKYYVSGSYPSEY

SEQ ID NO: 6505 - protein, 9 aa, Homo sapiens
  Light chain CDR3 for antibody 3253 (IGKV1-9)
QQLNSYPYT

SEQ ID NO: 6506 - protein, 15 aa, Homo sapiens
  Heavy chain CDR3 for antibody 3253 (IGHV1-46)
AIYKYYSSASYPFDY

SEQ ID NO: 6507 - protein, 9 aa, Homo sapiens
  Light chain CDR3 for antibody 3254 (IGKV1-9)
QQLNSYPYT

SEQ ID NO: 6508 - protein, 15 aa, Homo sapiens
  Heavy chain CDR3 for antibody 3254 (IGHV1-46)
EREKYNGSGSDPFDY

SEQ ID NO: 6509 - protein, 9 aa, Homo sapiens
  Light chain CDR3 for antibody 3255 (IGKV1-9)
QQLNSHPFT

SEQ ID NO: 6510 - protein, 17 aa, Homo sapiens
  Heavy chain CDR3 for antibody 3255 (IGHV3-11)
AREITMLRGDTYYGMDV

SEQ ID NO: 6511 - protein, 9 aa, Homo sapiens
  Light chain CDR3 for antibody 3256 (IGKV1D-17)
LQHNSYPYT

SEQ ID NO: 6512 - protein, 17 aa, Homo sapiens
  Heavy chain CDR3 for antibody 3256 (IGHV3-33)
VREISLVRGDNYYGLDV

SEQ ID NO: 6513 - protein, 9 aa, Homo sapiens
  Light chain CDR3 for antibody 3257 (IGKV1-9)
QQLNSYPFT

SEQ ID NO: 6514 - protein, 17 aa, Homo sapiens
  Heavy chain CDR3 for antibody 3257 (IGHV3-33)
ARESAMVRGENCYGMDV

SEQ ID NO: 6515 - protein, 9 aa, Homo sapiens
  Light chain CDR3 for antibody 3258 (IGKV1-9)
QQFNSYPFT

SEQ ID NO: 6516 - protein, 17 aa, Homo sapiens
  Heavy chain CDR3 for antibody 3258 (IGHV3-h)
AREIALVRGDNYYGMDD

SEQ ID NO: 6517 - protein, 9 aa, Homo sapiens
  Light chain CDR3 for antibody 3259 (IGKV3D-7)
QQDYNLPFT

SEQ ID NO: 6518 - protein, 16 aa, Homo sapiens
  Heavy chain CDR3 for antibody 3259 (IGHV1-18)
AREGETMVRGVFAFDY

SEQ ID NO: 6519 - protein, 9 aa, Homo sapiens
  Light chain CDR3 for antibody 3260 (IGKV1-9)
QQFNSHPFT

SEQ ID NO: 6520 - protein, 17 aa, Homo sapiens
  Heavy chain CDR3 for antibody 3260 (IGHV3-33)
ARESTRVRGDNYYGLDV

SEQ ID NO: 6521 - protein, 9 aa, Homo sapiens
  Light chain CDR3 for antibody 3261 (IGKV1D-17)
LQHNSYPYT

SEQ ID NO: 6522 - protein, 15 aa, Homo sapiens
  Heavy chain CDR3 for antibody 3261 (IGHV1-46)
AREKDHGSGSYPFDY

SEQ ID NO: 6523 - protein, 9 aa, Homo sapiens
  Light chain CDR3 for antibody 3262 (IGKV6-21)
HQSSSLPYT

SEQ ID NO: 6524 - protein, 16 aa, Homo sapiens
  Heavy chain CDR3 for antibody 3262 (IGHV1-18)
AREGDTMVRGCIAIEY

SEQ ID NO: 6525 - protein, 9 aa, Homo sapiens
  Light chain CDR3 for antibody 3263 (IGKV1D-17)
LQHNCYPYT

SEQ ID NO: 6526 - protein, 15 aa, Homo sapiens
  Heavy chain CDR3 for antibody 3263 (IGHV1-46)
AREKYYGSGSDPWDY

SEQ ID NO: 6527 - protein, 9 aa, Homo sapiens
  Light chain CDR3 for antibody 3264 (IGKV1-9)
QHLNSYPFT

SEQ ID NO: 6528 - protein, 17 aa, Homo sapiens
  Heavy chain CDR3 for antibody 3264 (IGHV3-33)
AREITIIRGDNYYGMDV

SEQ ID NO: 6529 - protein, 9 aa, Homo sapiens
  Light chain CDR3 for antibody 3265 (IGKV1-9)
QQLNGYPYT

SEQ ID NO: 6530 - protein, 15 aa, Homo sapiens
  Heavy chain CDR3 for antibody 3265 (IGHV1-46)
SREKYYVSASYPFYY

SEQ ID NO: 6531 - protein, 9 aa, Homo sapiens
  Light chain CDR3 for antibody 3266 (IGKV1-9)
QQLNSYPYT

SEQ ID NO: 6532 - protein, 15 aa, Homo sapiens
  Heavy chain CDR3 for antibody 3266 (IGHV1-46)
AREKYYGSGNYPIDY

SEQ ID NO: 6533 - protein, 9 aa, Homo sapiens
  Light chain CDR3 for antibody 3267 (IGKV1-9)
QQLNGYPYT

SEQ ID NO: 6534 - protein, 15 aa, Homo sapiens
  Heavy chain CDR3 for antibody 3267 (IGHV1-46)
AREKGYGPGSYAFDY

SEQ ID NO: 6535 - protein, 9 aa, Homo sapiens
  Light chain CDR3 for antibody 3268 (IGKV1-9)
QQLNSYPLT

SEQ ID NO: 6536 - protein, 15 aa, Homo sapiens
  Heavy chain CDR3 for antibody 3268 (IGHV1-46)
AREKYSGSGSYAFDY

SEQ ID NO: 6537 - protein, 9 aa, Homo sapiens
  Light chain CDR3 for antibody 3269 (IGKV1-9)
QQLNGFPYT

SEQ ID NO: 6538 - protein, 15 aa, Homo sapiens
  Heavy chain CDR3 for antibody 3269 (IGHV1-46)
AREKYYGSGSSPFAY

SEQ ID NO: 6539 - protein, 9 aa, Homo sapiens
  Light chain CDR3 for antibody 3270 (IGKV1-9)
QQLTSYPYT

SEQ ID NO: 6540 - protein, 15 aa, Homo sapiens
  Heavy chain CDR3 for antibody 3270 (IGHV1-46)
GREKSYGSGSYPSDY

SEQ ID NO: 6541 - protein, 9 aa, Homo sapiens
  Light chain CDR3 for antibody 3271 (IGKV1-9)
QQLNSYPLT

SEQ ID NO: 6542 - protein, 15 aa, Homo sapiens
  Heavy chain CDR3 for antibody 3271 (IGHV1-46)
AREGLSGYYPNCCDH

SEQ ID NO: 6543 - protein, 9 aa, Homo sapiens
  Light chain CDR3 for antibody 3272 (IGKV1-9)
QQLNGYPYT

SEQ ID NO: 6544 - protein, 15 aa, Homo sapiens
  Heavy chain CDR3 for antibody 3272 (IGHV1-46)
AREKYYGWGSYPLDY

SEQ ID NO: 6545 - protein, 9 aa, Homo sapiens
  Light chain CDR3 for antibody 3273 (IGKV1D-17)
LQHNSYPYT

SEQ ID NO: 6546 - protein, 10 aa, Homo sapiens
  Heavy chain CDR3 for antibody 3273 (IGHV3-33)
AREALAGIDS

SEQ ID NO: 6547 - protein, 9 aa, Homo sapiens
  Light chain CDR3 for antibody 3274 (IGKV1-9)
QQLNSYPLT

SEQ ID NO: 6548 - protein, 15 aa, Homo sapiens
  Heavy chain CDR3 for antibody 3274 (IGHV1-46)
AREKSYGSGTYPFAY

SEQ ID NO: 6549 - protein, 9 aa, Homo sapiens
  Light chain CDR3 for antibody 3275 (IGKV1D-17)
LQHNSYPYT

SEQ ID NO: 6550 - protein, 10 aa, Homo sapiens
  Heavy chain CDR3 for antibody 3275 (IGHV3-33)
ARESTYAIDF

SEQ ID NO: 6551 - protein, 9 aa, Homo sapiens
  Light chain CDR3 for antibody 3276 (IGKV6-21)
HQSSSLPYT

SEQ ID NO: 6552 - protein, 16 aa, Homo sapiens
  Heavy chain CDR3 for antibody 3276 (IGHV1-18)
AREGYTMVPGFIAFDY

SEQ ID NO: 6553 - protein, 9 aa, Homo sapiens
  Light chain CDR3 for antibody 3277 (IGKV1-9)
QQLNSYPYT

SEQ ID NO: 6554 - protein, 17 aa, Homo sapiens
  Heavy chain CDR3 for antibody 3277 (IGHV3-33)
AREIAMVRGYNYYGMDG

SEQ ID NO: 6555 - protein, 9 aa, Homo sapiens
  Light chain CDR3 for antibody 3278 (IGKV1-9)
QQLNSYPYT

SEQ ID NO: 6556 - protein, 15 aa, Homo sapiens
  Heavy chain CDR3 for antibody 3278 (IGHV1-46)
ARENYYGSGSSPIAY

SEQ ID NO: 6557 - protein, 9 aa, Homo sapiens
  Light chain CDR3 for antibody 3279 (IGKV1-9)
QQLNGYPYT

SEQ ID NO: 6558 - protein, 15 aa, Homo sapiens
  Heavy chain CDR3 for antibody 3279 (IGHV1-46)
GREKSYGSGSYPLDY

SEQ ID NO: 6559 - protein, 9 aa, Homo sapiens
  Light chain CDR3 for antibody 3280 (IGKV1-9)
QQLNSYPLT

SEQ ID NO: 6560 - protein, 17 aa, Homo sapiens
  Heavy chain CDR3 for antibody 3280 (IGHV3-33)
AREITMLRGDNYYGMAV

SEQ ID NO: 6561 - protein, 9 aa, Homo sapiens
  Light chain CDR3 for antibody 3281 (IGKV1-9)
QQLNSYPYT

SEQ ID NO: 6562 - protein, 16 aa, Homo sapiens
  Heavy chain CDR3 for antibody 3281 (IGHV1-69)
ATEGAVAGYYYYGMDV

SEQ ID NO: 6563 - protein, 9 aa, Homo sapiens
  Light chain CDR3 for antibody 3282 (IGKV6-21)
HQSSSLPYT

SEQ ID NO: 6564 - protein, 13 aa, Homo sapiens
  Heavy chain CDR3 for antibody 3282 (IGHV1-18)
AREGGNYIDSFAY

SEQ ID NO: 6565 - protein, 9 aa, Homo sapiens
  Light chain CDR3 for antibody 3283 (IGKV1-9)
QQLNGYPYT

SEQ ID NO: 6566 - protein, 15 aa, Homo sapiens
  Heavy chain CDR3 for antibody 3283 (IGHV1-46)
AREKYYGSGSYPFDC

SEQ ID NO: 6567 - protein, 9 aa, Homo sapiens
  Light chain CDR3 for antibody 3284 (IGKV1-6)
LQDYNYPRT

SEQ ID NO: 6568 - protein, 16 aa, Homo sapiens
  Heavy chain CDR3 for antibody 3284 (IGHV1-18)
AREGDTMVRGVIAFDY

SEQ ID NO: 6569 - protein, 9 aa, Homo sapiens
  Light chain CDR3 for antibody 3285 (IGKV1-6)
LQDYNYPYT

SEQ ID NO: 6570 - protein, 17 aa, Homo sapiens
  Heavy chain CDR3 for antibody 3285 (IGHV3-33)
AREIAMVRGDNYYGMDA

SEQ ID NO: 6571 - protein, 9 aa, Homo sapiens
  Light chain CDR3 for antibody 3286 (IGKV6-21)
HQSSSLPYT

SEQ ID NO: 6572 - protein, 13 aa, Homo sapiens
  Heavy chain CDR3 for antibody 3286 (IGHV1-2)
ARDDYGDYDYFDF

SEQ ID NO: 6573 - protein, 9 aa, Homo sapiens
  Light chain CDR3 for antibody 3287 (IGKV1-9)
QQLNSYPFT

SEQ ID NO: 6574 - protein, 17 aa, Homo sapiens
  Heavy chain CDR3 for antibody 3287 (IGHV3-33)
EREITMLRGDTYYGLDV

SEQ ID NO: 6575 - protein, 9 aa, Homo sapiens
  Light chain CDR3 for antibody 3288 (IGKV1D-16)
QQYNSYPRT

SEQ ID NO: 6576 - protein, 14 aa, Homo sapiens
  Heavy chain CDR3 for antibody 3288 (IGHV3-33)
ARDGRYDILTGGDY

SEQ ID NO: 6577 - protein, 9 aa, Homo sapiens
  Light chain CDR3 for antibody 3289 (IGKV1-9)
QQLNSYPYT

SEQ ID NO: 6578 - protein, 15 aa, Homo sapiens
  Heavy chain CDR3 for antibody 3289 (IGHV1-46)
AREKYYGSESYPLDY

SEQ ID NO: 6579 - protein, 8 aa, Homo sapiens
  Light chain CDR3 for antibody 3290 (IGKV3-20)
QQYGSSLT

SEQ ID NO: 6580 - protein, 15 aa, Homo sapiens
  Heavy chain CDR3 for antibody 3290 (IGHV3-33)
ARDRDYSYYYYGMDV

SEQ ID NO: 6581 - protein, 9 aa, Homo sapiens
  Light chain CDR3 for antibody 3291 (IGKV1D-17)
LQHNSYPYT

SEQ ID NO: 6582 - protein, 17 aa, Homo sapiens
  Heavy chain CDR3 for antibody 3291 (IGHV3-33)
ASEITLVRGDNYYAMDV

SEQ ID NO: 6583 - protein, 9 aa, Homo sapiens
  Light chain CDR3 for antibody 3292 (IGKV1-9)
QQLNSYPYT

SEQ ID NO: 6584 - protein, 17 aa, Homo sapiens
  Heavy chain CDR3 for antibody 3292 (IGHV3-33)
AREITMFRGDNYYAMNV

SEQ ID NO: 6585 - protein, 9 aa, Homo sapiens
  Light chain CDR3 for antibody 3293 (IGKV1-9)
QQLNSYPYT

SEQ ID NO: 6586 - protein, 15 aa, Homo sapiens
  Heavy chain CDR3 for antibody 3293 (IGHV1-46)
AREKYYCSENYAFDY

SEQ ID NO: 6587 - protein, 9 aa, Homo sapiens
  Light chain CDR3 for antibody 3294 (IGKV1-9)
QQLNSHPFT

SEQ ID NO: 6588 - protein, 11 aa, Homo sapiens
  Heavy chain CDR3 for antibody 3294 (IGHV1-8)
AREGAGSYLGY

SEQ ID NO: 6589 - protein, 9 aa, Homo sapiens
  Light chain CDR3 for antibody 3295 (IGKV1-9)
QQLNGYPYT

SEQ ID NO: 6590 - protein, 17 aa, Homo sapiens
  Heavy chain CDR3 for antibody 3295 (IGHV3-66)
AREITMLRGDTYYGMDV

SEQ ID NO: 6591 - protein, 9 aa, Homo sapiens
  Light chain CDR3 for antibody 3296 (IGKV6-21)
HQSSSLPYT

SEQ ID NO: 6592 - protein, 16 aa, Homo sapiens
  Heavy chain CDR3 for antibody 3296 (IGHV1-18)
AREEYTMVQAVIAFDY

SEQ ID NO: 6593 - protein, 9 aa, Homo sapiens
  Light chain CDR3 for antibody 3297 (IGKV1-9)
QHLNSYPFT

SEQ ID NO: 6594 - protein, 17 aa, Homo sapiens
  Heavy chain CDR3 for antibody 3297 (IGHV3-33)
AREINMVRGDDYYGMAV

SEQ ID NO: 6595 - protein, 8 aa, Homo sapiens
  Light chain CDR3 for antibody 3298 (IGKV3D-7)
QQDYNLFT

SEQ ID NO: 6596 - protein, 10 aa, Homo sapiens
  Heavy chain CDR3 for antibody 3298 (IGHV1-46)
AREWESYFDY

SEQ ID NO: 6597 - protein, 9 aa, Homo sapiens
  Light chain CDR3 for antibody 3299 (IGKV1-9)
LQLNGFPYT

SEQ ID NO: 6598 - protein, 15 aa, Homo sapiens
  Heavy chain CDR3 for antibody 3299 (IGHV1-46)
AREKCYGSGSYPFDY

SEQ ID NO: 6599 - protein, 9 aa, Homo sapiens
  Light chain CDR3 for antibody 3300 (IGKV1D-17)
QQLNGFPYT

SEQ ID NO: 6600 - protein, 15 aa, Homo sapiens
  Heavy chain CDR3 for antibody 3300 (IGHV1-46)
AREKYHGAGSDPFDY

SEQ ID NO: 6601 - protein, 9 aa, Homo sapiens
  Light chain CDR3 for antibody 3301 (IGKV1-9)
QQLNGYPYT

SEQ ID NO: 6602 - protein, 15 aa, Homo sapiens
  Heavy chain CDR3 for antibody 3301 (IGHV1-46)
AREKNYGSGSYPFDY

SEQ ID NO: 6603 - protein, 9 aa, Homo sapiens
  Light chain CDR3 for antibody 3302 (IGKV1-9)
QQLNGYPYT

SEQ ID NO: 6604 - protein, 16 aa, Homo sapiens
  Heavy chain CDR3 for antibody 3302 (IGHVVISTA32)
AREGEAMVRGVIALDY

SEQ ID NO: 6605 - protein, 9 aa, Homo sapiens
  Light chain CDR3 for antibody 3303 (IGKV1-9)
QQLNSYPFT

SEQ ID NO: 6606 - protein, 17 aa, Homo sapiens
  Heavy chain CDR3 for antibody 3303 (IGHV3-23)
SSEITMVRGDNYYAMDV

SEQ ID NO: 6607 - protein, 9 aa, Homo sapiens
  Light chain CDR3 for antibody 3304 (IGKV1-9)
QQLNSYPYT

SEQ ID NO: 6608 - protein, 15 aa, Homo sapiens
  Heavy chain CDR3 for antibody 3304 (IGHV1-46)
AREKYYGSGSYAIDY

SEQ ID NO: 6609 - protein, 9 aa, Homo sapiens
  Light chain CDR3 for antibody 3305 (IGKV1-9)
QQLNSYPFT

SEQ ID NO: 6610 - protein, 20 aa, Homo sapiens
  Heavy chain CDR3 for antibody 3305 (IGHV4-39)
ARRGDYYGSGSYYNIVYFDY

SEQ ID NO: 6611 - protein, 9 aa, Homo sapiens
  Light chain CDR3 for antibody 3306 (IGKV1-9)
QQLNSYPLT

SEQ ID NO: 6612 - protein, 15 aa, Homo sapiens
  Heavy chain CDR3 for antibody 3306 (IGHV1-46)
AREDLAGYYTNWFDS

SEQ ID NO: 6613 - protein, 9 aa, Homo sapiens
  Light chain CDR3 for antibody 3307 (IGKV1-9)
QQLNSYPFT

SEQ ID NO: 6614 - protein, 17 aa, Homo sapiens
  Heavy chain CDR3 for antibody 3307 (IGHV3-33)
AREITRFRGDNYYGMDF

SEQ ID NO: 6615 - protein, 9 aa, Homo sapiens
  Light chain CDR3 for antibody 3308 (IGKV6-21)
HQSSSLPYT

SEQ ID NO: 6616 - protein, 16 aa, Homo sapiens
  Heavy chain CDR3 for antibody 3308 (IGHV1-2)
AREADTMVPRLIAFDY

SEQ ID NO: 6617 - protein, 9 aa, Homo sapiens
  Light chain CDR3 for antibody 3309 (IGKV1-9)
QQLNSYPLT

SEQ ID NO: 6618 - protein, 15 aa, Homo sapiens
  Heavy chain CDR3 for antibody 3309 (IGHV1-46)
AIDGLAGYYPNGFDS

SEQ ID NO: 6619 - protein, 9 aa, Homo sapiens
  Light chain CDR3 for antibody 3310 (IGKV1-9)
QQLNSYPYT

SEQ ID NO: 6620 - protein, 15 aa, Homo sapiens
  Heavy chain CDR3 for antibody 3310 (IGHV1-46)
AREKYYGAGRSPFDY

SEQ ID NO: 6621 - protein, 9 aa, Homo sapiens
  Light chain CDR3 for antibody 3311 (IGKV1-9)
QQLNSYPLT

SEQ ID NO: 6622 - protein, 17 aa, Homo sapiens
  Heavy chain CDR3 for antibody 3311 (IGHV3-33)
AREITMLRGYNYYGMDF

SEQ ID NO: 6623 - protein, 9 aa, Homo sapiens
  Light chain CDR3 for antibody 3312 (IGKV1-9)
HQLNSYPYT

SEQ ID NO: 6624 - protein, 15 aa, Homo sapiens
  Heavy chain CDR3 for antibody 3312 (IGHV1-46)
AREQYYGSGIYPFDY

SEQ ID NO: 6625 - protein, 9 aa, Homo sapiens
  Light chain CDR3 for antibody 3313 (IGKV1-9)
QQLNSYPYT

SEQ ID NO: 6626 - protein, 15 aa, Homo sapiens
  Heavy chain CDR3 for antibody 3313 (IGHV1-46)
AIDKYYGSPSYPFDY

SEQ ID NO: 6627 - protein, 9 aa, Homo sapiens
  Light chain CDR3 for antibody 3314 (IGKV1-9)
QQLNSYPYT

SEQ ID NO: 6628 - protein, 15 aa, Homo sapiens
  Heavy chain CDR3 for antibody 3314 (IGHV1-46)
AGEKCYGSASYPFDY

SEQ ID NO: 6629 - protein, 9 aa, Homo sapiens
  Light chain CDR3 for antibody 3315 (IGKV1-9)
QQLNSYPLT

SEQ ID NO: 6630 - protein, 15 aa, Homo sapiens
  Heavy chain CDR3 for antibody 3315 (IGHV1-46)
AREGLTGYYPNCIDA

SEQ ID NO: 6631 - protein, 9 aa, Homo sapiens
  Light chain CDR3 for antibody 3316 (IGKV1D-17)
LQHNSYPYT

SEQ ID NO: 6632 - protein, 10 aa, Homo sapiens
  Heavy chain CDR3 for antibody 3316 (IGHV3-33)
ARESTDGMDV

SEQ ID NO: 6633 - protein, 9 aa, Homo sapiens
  Light chain CDR3 for antibody 3317 (IGKV1-9)
QQLNSYPFT

SEQ ID NO: 6634 - protein, 17 aa, Homo sapiens
  Heavy chain CDR3 for antibody 3317 (IGHV3-33)
AREITMVRGDNYYGMDV

SEQ ID NO: 6635 - protein, 9 aa, Homo sapiens
  Light chain CDR3 for antibody 3318 (IGKV1-9)
QQLNSYPYT

SEQ ID NO: 6636 - protein, 15 aa, Homo sapiens
  Heavy chain CDR3 for antibody 3318 (IGHV1-46)
AREKYYGSGSYPFDY

SEQ ID NO: 6637 - protein, 9 aa, Homo sapiens
  Light chain CDR3 for antibody 3319 (IGKV1D-17)
LQHNSYPYT

SEQ ID NO: 6638 - protein, 10 aa, Homo sapiens
  Heavy chain CDR3 for antibody 3319 (IGHV3-33)
ARESVAGFDY

SEQ ID NO: 6639 - protein, 9 aa, Homo sapiens
  Light chain CDR3 for antibody 3320 (IGKV1-9)
QQLNSHPFT

SEQ ID NO: 6640 - protein, 17 aa, Homo sapiens
  Heavy chain CDR3 for antibody 3320 (IGHV3-33)
AREVTMVRGDNYYGLDV

SEQ ID NO: 6641 - protein, 9 aa, Homo sapiens
  Light chain CDR3 for antibody 3321 (IGKV1-9)
QQFNSHPFT

SEQ ID NO: 6642 - protein, 17 aa, Homo sapiens
  Heavy chain CDR3 for antibody 3321 (IGHV3-33)
AREITMLRGDNYYGLDV

SEQ ID NO: 6643 - protein, 9 aa, Homo sapiens
  Light chain CDR3 for antibody 3322 (IGKV1D-17)
LQHNSYPYT

SEQ ID NO: 6644 - protein, 17 aa, Homo sapiens
  Heavy chain CDR3 for antibody 3322 (IGHV3-33)
AREITMVRGDNYYGMDV

SEQ ID NO: 6645 - protein, 9 aa, Homo sapiens
  Light chain CDR3 for antibody 3323 (IGKV1-9)
QQLNSYPFT

SEQ ID NO: 6646 - protein, 10 aa, Homo sapiens
  Heavy chain CDR3 for antibody 3323 (IGHV3-33)
ARESTDGMDV

SEQ ID NO: 6647 - protein, 9 aa, Homo sapiens
  Light chain CDR3 for antibody 3324 (IGKV1D-17)
LQHNSYPWT

SEQ ID NO: 6648 - protein, 9 aa, Homo sapiens
  Heavy chain CDR3 for antibody 3324 (IGHV3-33)
AREGAGVDY

SEQ ID NO: 6649 - protein, 9 aa, Homo sapiens
  Light chain CDR3 for antibody 3325 (IGKV1D-17)
LQHNSYPYT

SEQ ID NO: 6650 - protein, 10 aa, Homo sapiens
  Heavy chain CDR3 for antibody 3325 (IGHV3-33)
AREGRTGFDY

SEQ ID NO: 6651 - protein, 9 aa, Homo sapiens
  Light chain CDR3 for antibody 3326 (IGKV3D-20)
QQYGSSPWT

SEQ ID NO: 6652 - protein, 19 aa, Homo sapiens
  Heavy chain CDR3 for antibody 3326 (IGHV1-18)
ARDHGYCSSTSCYRAWFDP

SEQ ID NO: 6653 - protein, 9 aa, Homo sapiens
  Light chain CDR3 for antibody 3327 (IGKV1-9)
QQLISYPYT

SEQ ID NO: 6654 - protein, 15 aa, Homo sapiens
  Heavy chain CDR3 for antibody 3327 (IGHV1-46)
AREKYYGSGSYPFDS

SEQ ID NO: 6655 - protein, 9 aa, Homo sapiens
  Light chain CDR3 for antibody 3328 (IGKV3D-20)
QQANSFPWT

SEQ ID NO: 6656 - protein, 19 aa, Homo sapiens
  Heavy chain CDR3 for antibody 3328 (IGHV1-18)
ARDHGYCSSTSCYRAWFDP

SEQ ID NO: 6657 - protein, 9 aa, Homo sapiens
  Light chain CDR3 for antibody 3329 (IGKV1-9)
QHLNSHPFT

SEQ ID NO: 6658 - protein, 17 aa, Homo sapiens
  Heavy chain CDR3 for antibody 3329 (IGHV3-33)
AREITMVRGDNYYGMDV

SEQ ID NO: 6659 - protein, 9 aa, Homo sapiens
  Light chain CDR3 for antibody 3330 (IGKV6-21)
HQSSSLPYT

SEQ ID NO: 6660 - protein, 16 aa, Homo sapiens
  Heavy chain CDR3 for antibody 3330 (IGHV1-18)
AREGDTMVRGVIAFDY

SEQ ID NO: 6661 - protein, 9 aa, Homo sapiens
  Light chain CDR3 for antibody 3331 (IGKV1D-17)
LQHNSYPYT

SEQ ID NO: 6662 - protein, 15 aa, Homo sapiens
  Heavy chain CDR3 for antibody 3331 (IGHV1-46)
AREKYYGSGSYPFDS

SEQ ID NO: 6663 - protein, 9 aa, Homo sapiens
  Light chain CDR3 for antibody 3332 (IGKV1-9)
QQLNSYPFT

SEQ ID NO: 6664 - protein, 10 aa, Homo sapiens
  Heavy chain CDR3 for antibody 3332 (IGHV3-33)
ARESVAGFDY

SEQ ID NO: 6665 - protein, 9 aa, Homo sapiens
  Light chain CDR3 for antibody 3333 (IGKV1-9)
HQLISYPYT

SEQ ID NO: 6666 - protein, 15 aa, Homo sapiens
  Heavy chain CDR3 for antibody 3333 (IGHV1-46)
AREKYYGSGSYPFDY

SEQ ID NO: 6667 - protein, 9 aa, Homo sapiens
  Light chain CDR3 for antibody 3334 (IGKV1-6)
QQYYSYPRT

SEQ ID NO: 6668 - protein, 11 aa, Homo sapiens
  Heavy chain CDR3 for antibody 3334 (IGHV4-39)
ARATMVRNFDY

SEQ ID NO: 6669 - protein, 9 aa, Homo sapiens
  Light chain CDR3 for antibody 3335 (IGKV1-8)
QQYYSYPLT

SEQ ID NO: 6670 - protein, 14 aa, Homo sapiens
  Heavy chain CDR3 for antibody 3335 (IGHV3-23)
AKNRAVAGLNWFDP

SEQ ID NO: 6671 - protein, 9 aa, Homo sapiens
  Light chain CDR3 for antibody 3336 (IGKV1-9)
QQLNSHPFT

SEQ ID NO: 6672 - protein, 15 aa, Homo sapiens
  Heavy chain CDR3 for antibody 3336 (IGHV1-46)
AREKYYGSGSYPFDS

SEQ ID NO: 6673 - protein, 9 aa, Homo sapiens
  Light chain CDR3 for antibody 3337 (IGKV1-9)
QQFNSYPFT

SEQ ID NO: 6674 - protein, 17 aa, Homo sapiens
  Heavy chain CDR3 for antibody 3337 (IGHV3-33)
AREITLVRGDNYYGMDV

SEQ ID NO: 6675 - protein, 9 aa, Homo sapiens
  Light chain CDR3 for antibody 3338 (IGKV3-20)
QQYGSSPLT

SEQ ID NO: 6676 - protein, 8 aa, Homo sapiens
  Heavy chain CDR3 for antibody 3338 (IGHV4-59)
ASGACFDY

SEQ ID NO: 6677 - protein, 9 aa, Homo sapiens
  Light chain CDR3 for antibody 3339 (IGKV1-9)
HQLNSYPYT

SEQ ID NO: 6678 - protein, 15 aa, Homo sapiens
  Heavy chain CDR3 for antibody 3339 (IGHV1-46)
AREKYHGSGSYPFDY

SEQ ID NO: 6679 - protein, 9 aa, Homo sapiens
  Light chain CDR3 for antibody 3340 (IGKV1-27)
QKYNSAPLT

SEQ ID NO: 6680 - protein, 13 aa, Homo sapiens
  Heavy chain CDR3 for antibody 3340 (IGHV3-33)
ARDWYYGSGSPYY

SEQ ID NO: 6681 - protein, 9 aa, Homo sapiens
  Light chain CDR3 for antibody 3341 (IGKV3D-20)
QHYGSSPWT

SEQ ID NO: 6682 - protein, 11 aa, Homo sapiens
  Heavy chain CDR3 for antibody 3341 (IGHV3-33)
ARDRRVGATDY

SEQ ID NO: 6683 - protein, 9 aa, Homo sapiens
  Light chain CDR3 for antibody 3342 (IGKV1-16)
QQYNSYPWT

SEQ ID NO: 6684 - protein, 14 aa, Homo sapiens
  Heavy chain CDR3 for antibody 3342 (IGHV4-34)
ARVLLWFGMGWFDP

SEQ ID NO: 6685 - protein, 9 aa, Homo sapiens
  Light chain CDR3 for antibody 3343 (IGKV1-9)
QQFNSYPFT

SEQ ID NO: 6686 - protein, 17 aa, Homo sapiens
  Heavy chain CDR3 for antibody 3343 (IGHV3-33)
GREITMVRGDNYYGMDV

SEQ ID NO: 6687 - protein, 9 aa, Homo sapiens
  Light chain CDR3 for antibody 3344 (IGKV3-15)
QQYNNWPRT

SEQ ID NO: 6688 - protein, 16 aa, Homo sapiens
  Heavy chain CDR3 for antibody 3344 (IGHV3-33)
ARDRDIVATGEYYFDY

SEQ ID NO: 6689 - protein, 9 aa, Homo sapiens
  Light chain CDR3 for antibody 3345 (IGKV1-12)
QQANSFPWT

SEQ ID NO: 6690 - protein, 13 aa, Homo sapiens
  Heavy chain CDR3 for antibody 3345 (IGHV1-18)
AREGGSYYVSFDY

SEQ ID NO: 6691 - protein, 9 aa, Homo sapiens
  Light chain CDR3 for antibody 3346 (IGKV1-9)
QQLNSYPFT

SEQ ID NO: 6692 - protein, 17 aa, Homo sapiens
  Heavy chain CDR3 for antibody 3346 (IGHV3-33)
VREITMVRGDNYYGLDV

SEQ ID NO: 6693 - protein, 9 aa, Homo sapiens
  Light chain CDR3 for antibody 3347 (IGKV1D-17)
LQHNSYPYT

SEQ ID NO: 6694 - protein, 12 aa, Homo sapiens
  Heavy chain CDR3 for antibody 3347 (IGHV4-39)
ARQGSYLSWFDP

SEQ ID NO: 6695 - protein, 9 aa, Homo sapiens
  Light chain CDR3 for antibody 3348 (IGKV1D-16)
QQYNSYPPT

SEQ ID NO: 6696 - protein, 13 aa, Homo sapiens
  Heavy chain CDR3 for antibody 3348 (IGHV1-24)
ATTYSGYAYYFDY

SEQ ID NO: 6697 - protein, 9 aa, Homo sapiens
  Light chain CDR3 for antibody 3349 (IGKV1D-17)
LQHNSYPYT

SEQ ID NO: 6698 - protein, 10 aa, Homo sapiens
  Heavy chain CDR3 for antibody 3349 (IGHV3-33)
ARESGEGFDY

SEQ ID NO: 6699 - protein, 9 aa, Homo sapiens
  Light chain CDR3 for antibody 3350 (IGKV1-8)
QQYYSYPLT

SEQ ID NO: 6700 - protein, 14 aa, Homo sapiens
  Heavy chain CDR3 for antibody 3350 (IGHV3-23)
AKDRAVAGTYYFDY

SEQ ID NO: 6701 - protein, 8 aa, Homo sapiens
  Light chain CDR3 for antibody 3351 (IGKV1-6)
LQDYNYPT

SEQ ID NO: 6702 - protein, 13 aa, Homo sapiens
  Heavy chain CDR3 for antibody 3351 (IGHV1-24)
ATTYSGYAYYFDY

SEQ ID NO: 6703 - protein, 9 aa, Homo sapiens
  Light chain CDR3 for antibody 3352 (IGKV1-6)
LQDYNYPYT

SEQ ID NO: 6704 - protein, 14 aa, Homo sapiens
  Heavy chain CDR3 for antibody 3352 (IGHV1-8)
ARGPTVRGVIRFDY

SEQ ID NO: 6705 - protein, 9 aa, Homo sapiens
  Light chain CDR3 for antibody 3353 (IGKV1-9)
QQLNSYPFT

SEQ ID NO: 6706 - protein, 9 aa, Homo sapiens
  Heavy chain CDR3 for antibody 3353 (IGHV3-33)
AREGAGVDY

SEQ ID NO: 6707 - protein, 9 aa, Homo sapiens
  Light chain CDR3 for antibody 3354 (IGKV1-9)
QQLNSYPFT

SEQ ID NO: 6708 - protein, 10 aa, Homo sapiens
  Heavy chain CDR3 for antibody 3354 (IGHV3-33)
AREGRTGFDY

SEQ ID NO: 6709 - protein, 9 aa, Homo sapiens
  Light chain CDR3 for antibody 3355 (IGKV3D-20)
QQYGSSPRT

SEQ ID NO: 6710 - protein, 15 aa, Homo sapiens
  Heavy chain CDR3 for antibody 3355 (IGHV1-18)
ARDYDILTGYYPLDY

SEQ ID NO: 6711 - protein, 9 aa, Homo sapiens
  Light chain CDR3 for antibody 3356 (IGKV2D-30)
MQGTHWPPT

SEQ ID NO: 6712 - protein, 8 aa, Homo sapiens
  Heavy chain CDR3 for antibody 3356 (IGHV4-59)
ARDEGMDV

SEQ ID NO: 6713 - protein, 9 aa, Homo sapiens
  Light chain CDR3 for antibody 3357 (IGKV1D-17)
LQHNSYPYT

SEQ ID NO: 6714 - protein, 10 aa, Homo sapiens
  Heavy chain CDR3 for antibody 3357 (IGHV3-33)
ARDSPDGMDA

SEQ ID NO: 6715 - protein, 9 aa, Homo sapiens
  Light chain CDR3 for antibody 3358 (IGKV5-2)
LQHANFPWT

SEQ ID NO: 6716 - protein, 12 aa, Homo sapiens
  Heavy chain CDR3 for antibody 3358 (IGHV4-59)
ARAVVGHNGMDV

SEQ ID NO: 6717 - protein, 9 aa, Homo sapiens
  Light chain CDR3 for antibody 3359 (IGKV1-9)
QQLISYPYT

SEQ ID NO: 6718 - protein, 17 aa, Homo sapiens
  Heavy chain CDR3 for antibody 3359 (IGHV3-33)
AREITMVRGDNYYGLDV

SEQ ID NO: 6719 - protein, 9 aa, Homo sapiens
  Light chain CDR3 for antibody 3360 (IGKV3-15)
QQYNNWPRT

SEQ ID NO: 6720 - protein, 10 aa, Homo sapiens
  Heavy chain CDR3 for antibody 3360 (IGHV3-33)
ARESTDGMDV

SEQ ID NO: 6721 - protein, 9 aa, Homo sapiens
  Light chain CDR3 for antibody 3361 (IGKV1-9)
QQFNSYPFT

SEQ ID NO: 6722 - protein, 17 aa, Homo sapiens
  Heavy chain CDR3 for antibody 3361 (IGHV3-33)
AREITMVRGDNYYGLDV

SEQ ID NO: 6723 - protein, 9 aa, Homo sapiens
  Light chain CDR3 for antibody 3362 (IGKV1-27)
QKYNSAPYT

SEQ ID NO: 6724 - protein, 13 aa, Homo sapiens
  Heavy chain CDR3 for antibody 3362 (IGHV3-33)
ARVLRYFDPDFDY

SEQ ID NO: 6725 - protein, 9 aa, Homo sapiens
  Light chain CDR3 for antibody 3363 (IGKV1-9)
QRLNSYPYT

SEQ ID NO: 6726 - protein, 13 aa, Homo sapiens
  Heavy chain CDR3 for antibody 3363 (IGHV3-33)
ARDYCGGDCYPDP

SEQ ID NO: 6727 - protein, 9 aa, Homo sapiens
  Light chain CDR3 for antibody 3364 (IGKV1-6)
LQDYNYPWT

SEQ ID NO: 6728 - protein, 8 aa, Homo sapiens
  Heavy chain CDR3 for antibody 3364 (IGHV4-59)
ASGACFDY

SEQ ID NO: 6729 - protein, 9 aa, Homo sapiens
  Light chain CDR3 for antibody 3365 (IGKV1-8)
QQYYSYPFT

SEQ ID NO: 6730 - protein, 13 aa, Homo sapiens
  Heavy chain CDR3 for antibody 3365 (IGHV3-23)
AKGPITISLYFDY

SEQ ID NO: 6731 - protein, 9 aa, Homo sapiens
  Light chain CDR3 for antibody 3366 (IGKV1-9)
QQLNSYPYT

SEQ ID NO: 6732 - protein, 19 aa, Homo sapiens
  Heavy chain CDR3 for antibody 3366 (IGHV1-18)
ARDHGYCSSTSCYRAWFDP

SEQ ID NO: 6733 - protein, 8 aa, Homo sapiens
  Light chain CDR3 for antibody 3367 (IGKV1-17)
LQHNSYRT

SEQ ID NO: 6734 - protein, 10 aa, Homo sapiens
  Heavy chain CDR3 for antibody 3367 (IGHV1-18)
ARSPYYDIDY

SEQ ID NO: 6735 - protein, 9 aa, Homo sapiens
  Light chain CDR3 for antibody 3368 (IGKV1-6)
LQDYNYPYT

SEQ ID NO: 6736 - protein, 18 aa, Homo sapiens
  Heavy chain CDR3 for antibody 3368 (IGHV3-33)
ARYGDPERDYYYYYGMDV

SEQ ID NO: 6737 - protein, 9 aa, Homo sapiens
  Light chain CDR3 for antibody 3369 (IGKV1-6)
LQDYNYPWT

SEQ ID NO: 6738 - protein, 10 aa, Homo sapiens
  Heavy chain CDR3 for antibody 3369 (IGHV1-24)
ATDRNWVFDY

SEQ ID NO: 6739 - protein, 9 aa, Homo sapiens
  Light chain CDR3 for antibody 3370 (IGKV1-5)
QQYNSYYRT

SEQ ID NO: 6740 - protein, 19 aa, Homo sapiens
  Heavy chain CDR3 for antibody 3370 (IGHV1-18)
ARDHGYCSSTSCYRAWFDP

SEQ ID NO: 6741 - protein, 9 aa, Homo sapiens
  Light chain CDR3 for antibody 3371 (IGKV1-9)
QQLNSHPFT

SEQ ID NO: 6742 - protein, 17 aa, Homo sapiens
  Heavy chain CDR3 for antibody 3371 (IGHV3-33)
AREITMVRGDTSYGMDV

SEQ ID NO: 6743 - protein, 9 aa, Homo sapiens
  Light chain CDR3 for antibody 3372 (IGKV1-6)
LQDYNYPYT

SEQ ID NO: 6744 - protein, 15 aa, Homo sapiens
  Heavy chain CDR3 for antibody 3372 (IGHV3-33)
ARRGYSYGYPDYFDY

SEQ ID NO: 6745 - protein, 9 aa, Homo sapiens
  Light chain CDR3 for antibody 3373 (IGKV1D-17)
LQHNSYPYT

SEQ ID NO: 6746 - protein, 10 aa, Homo sapiens
  Heavy chain CDR3 for antibody 3373 (IGHV3-33)
ARAATDGMDA

SEQ ID NO: 6747 - protein, 9 aa, Homo sapiens
  Light chain CDR3 for antibody 3374 (IGKV1-27)
QKYNSAPLT

SEQ ID NO: 6748 - protein, 16 aa, Homo sapiens
  Heavy chain CDR3 for antibody 3374 (IGHV3-33)
ARDRDIVATGEYYFDY

SEQ ID NO: 6749 - protein, 9 aa, Homo sapiens
  Light chain CDR3 for antibody 3375 (IGKV1D-17)
LQHNSYPYT

SEQ ID NO: 6750 - protein, 10 aa, Homo sapiens
  Heavy chain CDR3 for antibody 3375 (IGHV3-33)
ARETVRGIDY

SEQ ID NO: 6751 - protein, 9 aa, Homo sapiens
  Light chain CDR3 for antibody 3376 (IGKV1-8)
QQYYSYPIT

SEQ ID NO: 6752 - protein, 10 aa, Homo sapiens
  Heavy chain CDR3 for antibody 3376 (IGHV3-33)
ARVDQLLFDY

SEQ ID NO: 6753 - protein, 9 aa, Homo sapiens
  Light chain CDR3 for antibody 3377 (IGKV1-12)
QQANSFPWT

SEQ ID NO: 6754 - protein, 13 aa, Homo sapiens
  Heavy chain CDR3 for antibody 3377 (IGHV1-24)
ATTYSGYAYYFDY

SEQ ID NO: 6755 - protein, 9 aa, Homo sapiens
  Light chain CDR3 for antibody 3378 (IGKV1-17)
LQHNSYPYT

SEQ ID NO: 6756 - protein, 27 aa, Homo sapiens
  Heavy chain CDR3 for antibody 3378 (IGHV3-20)
VRDRHIVVVTADIREDSYYYYYYGMDV

SEQ ID NO: 6757 - protein, 9 aa, Homo sapiens
  Light chain CDR3 for antibody 3379 (IGKV1-27)
QKYNSAPLT

SEQ ID NO: 6758 - protein, 10 aa, Homo sapiens
  Heavy chain CDR3 for antibody 3379 (IGHV3-33)
ARESTDGMDV

SEQ ID NO: 6759 - protein, 9 aa, Homo sapiens
  Light chain CDR3 for antibody 3380 (IGKV1-9)
QQLNSHPFT

SEQ ID NO: 6760 - protein, 17 aa, Homo sapiens
  Heavy chain CDR3 for antibody 3380 (IGHV3-33)
EREITMVRGDNYDGMDV

SEQ ID NO: 6761 - protein, 9 aa, Homo sapiens
  Light chain CDR3 for antibody 3381 (IGKV1-6)
LQDYNYPWT

SEQ ID NO: 6762 - protein, 10 aa, Homo sapiens
  Heavy chain CDR3 for antibody 3381 (IGHV3-33)
AREIWDDYDY

SEQ ID NO: 6763 - protein, 9 aa, Homo sapiens
  Light chain CDR3 for antibody 3382 (IGKV1-8)
QQYYSYPFT

SEQ ID NO: 6764 - protein, 17 aa, Homo sapiens
  Heavy chain CDR3 for antibody 3382 (IGHV3-33)
AREITMVRGDNYYGLDV

SEQ ID NO: 6765 - protein, 9 aa, Homo sapiens
  Light chain CDR3 for antibody 3383 (IGKV1-6)
LQDYNYPWT

SEQ ID NO: 6766 - protein, 16 aa, Homo sapiens
  Heavy chain CDR3 for antibody 3383 (IGHV1-46)
ARDRIAVAGGSYGMDV

SEQ ID NO: 6767 - protein, 9 aa, Homo sapiens
  Light chain CDR3 for antibody 3384 (IGKV1-9)
HQLISYPYT

SEQ ID NO: 6768 - protein, 10 aa, Homo sapiens
  Heavy chain CDR3 for antibody 3384 (IGHV3-33)
ARESTDGMDV

SEQ ID NO: 6769 - protein, 9 aa, Homo sapiens
  Light chain CDR3 for antibody 3385 (IGKV1-9)
QQLNSYPPT

SEQ ID NO: 6770 - protein, 16 aa, Homo sapiens
  Heavy chain CDR3 for antibody 3385 (IGHV1-18)
AMTTVTTDYYYYGMDV

SEQ ID NO: 6771 - protein, 9 aa, Homo sapiens
  Light chain CDR3 for antibody 3386 (IGKV1-9)
QQLDSYPFI

SEQ ID NO: 6772 - protein, 17 aa, Homo sapiens
  Heavy chain CDR3 for antibody 3386 (IGHV3-33)
AREITMVRGDNYYGLDV

SEQ ID NO: 6773 - protein, 9 aa, Homo sapiens
  Light chain CDR3 for antibody 3387 (IGKV1-9)
QHLNSHPFT

SEQ ID NO: 6774 - protein, 10 aa, Homo sapiens
  Heavy chain CDR3 for antibody 3387 (IGHV3-33)
ARESTDGMDA

SEQ ID NO: 6775 - protein, 9 aa, Homo sapiens
  Light chain CDR3 for antibody 3388 (IGKV1-9)
QQLNGYPYT

SEQ ID NO: 6776 - protein, 15 aa, Homo sapiens
  Heavy chain CDR3 for antibody 3388 (IGHV1-46)
AREKSYGSGSSPFDY

SEQ ID NO: 6777 - protein, 9 aa, Homo sapiens
  Light chain CDR3 for antibody 3389 (IGKV1D-17)
LQHNSYPYT

SEQ ID NO: 6778 - protein, 10 aa, Homo sapiens
  Heavy chain CDR3 for antibody 3389 (IGHV3-33)
ARESTYGIDA

SEQ ID NO: 6779 - protein, 9 aa, Homo sapiens
  Light chain CDR3 for antibody 3390 (IGKV1D-17)
LQHNSYPYT

SEQ ID NO: 6780 - protein, 10 aa, Homo sapiens
  Heavy chain CDR3 for antibody 3390 (IGHV3-33)
ARDATDGIDV

SEQ ID NO: 6781 - protein, 9 aa, Homo sapiens
  Light chain CDR3 for antibody 3391 (IGKV1D-17)
LQHNSYPYT

SEQ ID NO: 6782 - protein, 17 aa, Homo sapiens
  Heavy chain CDR3 for antibody 3391 (IGHV3-33)
AREITMLRGDNYYGLDV

SEQ ID NO: 6783 - protein, 9 aa, Homo sapiens
  Light chain CDR3 for antibody 3392 (IGKV1-9)
QQLNSYPFT

SEQ ID NO: 6784 - protein, 17 aa, Homo sapiens
  Heavy chain CDR3 for antibody 3392 (IGHV3-33)
ARESTRVRGDNYYGLDV

SEQ ID NO: 6785 - protein, 9 aa, Homo sapiens
  Light chain CDR3 for antibody 3393 (IGKV1D-17)
LQHNSYPYT

SEQ ID NO: 6786 - protein, 13 aa, Homo sapiens
  Heavy chain CDR3 for antibody 3393 (IGHV1-24)
ATTYSGYVYYFDY

SEQ ID NO: 6787 - protein, 9 aa, Homo sapiens
  Light chain CDR3 for antibody 3394 (IGKV1D-17)
LQHNSYPYT

SEQ ID NO: 6788 - protein, 10 aa, Homo sapiens
  Heavy chain CDR3 for antibody 3394 (IGHV3-48)
ARESTYAMDF

SEQ ID NO: 6789 - protein, 9 aa, Homo sapiens
  Light chain CDR3 for antibody 3395 (IGKV1-8)
QQYYSYPLT

SEQ ID NO: 6790 - protein, 14 aa, Homo sapiens
  Heavy chain CDR3 for antibody 3395 (IGHV3-23)
AKEGIAVALYYFDY

SEQ ID NO: 6791 - protein, 9 aa, Homo sapiens
  Light chain CDR3 for antibody 3396 (IGKV1D-17)
LQHNSYPYT

SEQ ID NO: 6792 - protein, 17 aa, Homo sapiens
  Heavy chain CDR3 for antibody 3396 (IGHV3-33)
AREVTMVRGDNYYGLDV

SEQ ID NO: 6793 - protein, 9 aa, Homo sapiens
  Light chain CDR3 for antibody 3397 (IGKV1-9)
QQLNSYPFT

SEQ ID NO: 6794 - protein, 17 aa, Homo sapiens
  Heavy chain CDR3 for antibody 3397 (IGHV3-33)
EREINMVRGDNYYGLDV

SEQ ID NO: 6795 - protein, 9 aa, Homo sapiens
  Light chain CDR3 for antibody 3398 (IGKV1-9)
QQLNSYPFT

SEQ ID NO: 6796 - protein, 17 aa, Homo sapiens
  Heavy chain CDR3 for antibody 3398 (IGHV3-30)
AREITMFRGDNYYAIDV

SEQ ID NO: 6797 - protein, 9 aa, Homo sapiens
  Light chain CDR3 for antibody 3399 (IGKV3-15)
QQYNNWPRT

SEQ ID NO: 6798 - protein, 8 aa, Homo sapiens
  Heavy chain CDR3 for antibody 3399 (IGHV1-18)
ASGACFDY

SEQ ID NO: 6799 - protein, 9 aa, Homo sapiens
  Light chain CDR3 for antibody 3400 (IGKV1D-17)
LQHNSYPYT

SEQ ID NO: 6800 - protein, 10 aa, Homo sapiens
  Heavy chain CDR3 for antibody 3400 (IGHV3-30)
AGASTYGMDV

SEQ ID NO: 6801 - protein, 9 aa, Homo sapiens
  Light chain CDR3 for antibody 3401 (IGKV1-16)
QQYNSYPLT

SEQ ID NO: 6802 - protein, 14 aa, Homo sapiens
  Heavy chain CDR3 for antibody 3401 (IGHV1-18)
ARWWGGDYYYGMDV

SEQ ID NO: 6803 - protein, 9 aa, Homo sapiens
  Light chain CDR3 for antibody 3402 (IGKV1D-17)
LQHNSYPYT

SEQ ID NO: 6804 - protein, 10 aa, Homo sapiens
  Heavy chain CDR3 for antibody 3402 (IGHV3-33)
AREATEGFDY

SEQ ID NO: 6805 - protein, 9 aa, Homo sapiens
  Light chain CDR3 for antibody 3403 (IGKV3D-20)
QQYGSSPWT

SEQ ID NO: 6806 - protein, 15 aa, Homo sapiens
  Heavy chain CDR3 for antibody 3403 (IGHV1-46)
AREKYYGSGSYPFDY

SEQ ID NO: 6807 - protein, 9 aa, Homo sapiens
  Light chain CDR3 for antibody 3404 (IGKV1-17)
LQHNSYPWT

SEQ ID NO: 6808 - protein, 19 aa, Homo sapiens
  Heavy chain CDR3 for antibody 3404 (IGHV3-33)
AREDSSSWYPDYYYYGMDV

SEQ ID NO: 6809 - protein, 9 aa, Homo sapiens
  Light chain CDR3 for antibody 3405 (IGKV1-9)
QHLNSHPFT

SEQ ID NO: 6810 - protein, 10 aa, Homo sapiens
  Heavy chain CDR3 for antibody 3405 (IGHV3-33)
ARETVAGFDY

SEQ ID NO: 6811 - protein, 9 aa, Homo sapiens
  Light chain CDR3 for antibody 3406 (IGKV1-9)
QQLNSHPFT

SEQ ID NO: 6812 - protein, 17 aa, Homo sapiens
  Heavy chain CDR3 for antibody 3406 (IGHV3-33)
AREITMVRGDNYYGIDA

SEQ ID NO: 6813 - protein, 9 aa, Homo sapiens
  Light chain CDR3 for antibody 3407 (IGKV1D-17)
LQHNSYPYT

SEQ ID NO: 6814 - protein, 10 aa, Homo sapiens
  Heavy chain CDR3 for antibody 3407 (IGHV3-23)
AIESTYAIDV

SEQ ID NO: 6815 - protein, 9 aa, Homo sapiens
  Light chain CDR3 for antibody 3408 (IGKV1-9)
QQLNSHPFT

SEQ ID NO: 6816 - protein, 10 aa, Homo sapiens
  Heavy chain CDR3 for antibody 3408 (IGHV3-33)
ARESGEGFDY

SEQ ID NO: 6817 - protein, 9 aa, Homo sapiens
  Light chain CDR3 for antibody 3409 (IGKV1-9)
QHLNSHPFT

SEQ ID NO: 6818 - protein, 17 aa, Homo sapiens
  Heavy chain CDR3 for antibody 3409 (IGHV3-33)
AREITRVRGDNYYGMDV

SEQ ID NO: 6819 - protein, 9 aa, Homo sapiens
  Light chain CDR3 for antibody 3410 (IGKV1-5)
QQYNSYSRT

SEQ ID NO: 6820 - protein, 17 aa, Homo sapiens
  Heavy chain CDR3 for antibody 3410 (IGHV4-59)
ARTLFWFGELGGWYFDL

SEQ ID NO: 6821 - protein, 9 aa, Homo sapiens
  Light chain CDR3 for antibody 3411 (IGKV1-9)
QHLNSHPFT

SEQ ID NO: 6822 - protein, 17 aa, Homo sapiens
  Heavy chain CDR3 for antibody 3411 (IGHV3-33)
ARESTMVRGDNYYGMDV

SEQ ID NO: 6823 - protein, 9 aa, Homo sapiens
  Light chain CDR3 for antibody 3412 (IGKV1-9)
QQLISYPYT

SEQ ID NO: 6824 - protein, 15 aa, Homo sapiens
  Heavy chain CDR3 for antibody 3412 (IGHV1-46)
AREKYYGSGSYPFDA

SEQ ID NO: 6825 - protein, 9 aa, Homo sapiens
  Light chain CDR3 for antibody 3413 (IGKV1-8)
QQYYSYPIT

SEQ ID NO: 6826 - protein, 14 aa, Homo sapiens
  Heavy chain CDR3 for antibody 3413 (IGHV3-23)
AKGVVVTAMNWFDP

SEQ ID NO: 6827 - protein, 9 aa, Homo sapiens
  Light chain CDR3 for antibody 3414 (IGKV1-9)
QQFNSYPFT

SEQ ID NO: 6828 - protein, 17 aa, Homo sapiens
  Heavy chain CDR3 for antibody 3414 (IGHV3-33)
AREITVVRGDNYYGMDV

SEQ ID NO: 6829 - protein, 9 aa, Homo sapiens
  Light chain CDR3 for antibody 3415 (IGKV1-8)
QQYYSYPYT

SEQ ID NO: 6830 - protein, 14 aa, Homo sapiens
  Heavy chain CDR3 for antibody 3415 (IGHV3-23)
AKERAVAALNWFDP

SEQ ID NO: 6831 - protein, 9 aa, Homo sapiens
  Light chain CDR3 for antibody 3416 (IGKV1-9)
QQLNGYPYT

SEQ ID NO: 6832 - protein, 15 aa, Homo sapiens
  Heavy chain CDR3 for antibody 3416 (IGHV1-46)
AREKYYGSGSYPFAS

SEQ ID NO: 6833 - protein, 9 aa, Homo sapiens
  Light chain CDR3 for antibody 3417 (IGKV1-9)
QQLNSHPFT

SEQ ID NO: 6834 - protein, 17 aa, Homo sapiens
  Heavy chain CDR3 for antibody 3417 (IGHV3-33)
AREITMVRGENYYGMDV

SEQ ID NO: 6835 - protein, 9 aa, Homo sapiens
  Light chain CDR3 for antibody 3418 (IGKV3-15)
QQYNNWPRT

SEQ ID NO: 6836 - protein, 19 aa, Homo sapiens
  Heavy chain CDR3 for antibody 3418 (IGHV1-18)
ARDHGYCSSTSCYRAWFDP

SEQ ID NO: 6837 - protein, 9 aa, Homo sapiens
  Light chain CDR3 for antibody 3419 (IGKV1D-17)
LQHNSYPYT

SEQ ID NO: 6838 - protein, 10 aa, Homo sapiens
  Heavy chain CDR3 for antibody 3419 (IGHV3-33)
ARQSTDAIDV

SEQ ID NO: 6839 - protein, 9 aa, Homo sapiens
  Light chain CDR3 for antibody 3420 (IGKV3D-20)
QQYGSSPWT

SEQ ID NO: 6840 - protein, 10 aa, Homo sapiens
  Heavy chain CDR3 for antibody 3420 (IGHV3-33)
ARESTDGMDV

SEQ ID NO: 6841 - protein, 9 aa, Homo sapiens
  Light chain CDR3 for antibody 3421 (IGKV1-9)
QQFNSHPFT

SEQ ID NO: 6842 - protein, 10 aa, Homo sapiens
  Heavy chain CDR3 for antibody 3421 (IGHV3-33)
ARESTDGMDV

SEQ ID NO: 6843 - protein, 9 aa, Homo sapiens
  Light chain CDR3 for antibody 3422 (IGKV3-11)
QQRSNWPWT

SEQ ID NO: 6844 - protein, 27 aa, Homo sapiens
  Heavy chain CDR3 for antibody 3422 (IGHV3-20)
ARDRHIVVVTADIREDSYYYYYYGMDV

SEQ ID NO: 6845 - protein, 9 aa, Homo sapiens
  Light chain CDR3 for antibody 3423 (IGKV1-9)
QQLNSHPFT

SEQ ID NO: 6846 - protein, 17 aa, Homo sapiens
  Heavy chain CDR3 for antibody 3423 (IGHV3-33)
ARESTMVRGDNYYGMDV

SEQ ID NO: 6847 - protein, 9 aa, Homo sapiens
  Light chain CDR3 for antibody 3424 (IGKV1-9)
QQLISYPYT

SEQ ID NO: 6848 - protein, 15 aa, Homo sapiens
  Heavy chain CDR3 for antibody 3424 (IGHV1-46)
AREKYYGAGSYPFES

SEQ ID NO: 6849 - protein, 9 aa, Homo sapiens
  Light chain CDR3 for antibody 3425 (IGKV3-15)
QQYNNWPRT

SEQ ID NO: 6850 - protein, 17 aa, Homo sapiens
  Heavy chain CDR3 for antibody 3425 (IGHV3-33)
ARDRATVTLYYYYGMDV

SEQ ID NO: 6851 - protein, 9 aa, Homo sapiens
  Light chain CDR3 for antibody 3426 (IGKV1-27)
QKYNSAPLT

SEQ ID NO: 6852 - protein, 19 aa, Homo sapiens
  Heavy chain CDR3 for antibody 3426 (IGHV3-33)
AREDSSSWYPDYYYYGMDV

SEQ ID NO: 6853 - protein, 9 aa, Homo sapiens
  Light chain CDR3 for antibody 3427 (IGKV3D-20)
QQYGSSPWT

SEQ ID NO: 6854 - protein, 17 aa, Homo sapiens
  Heavy chain CDR3 for antibody 3427 (IGHV3-33)
AREITMVRGDNYYGMDV

SEQ ID NO: 6855 - protein, 9 aa, Homo sapiens
  Light chain CDR3 for antibody 3428 (IGKV1-9)
QQLISYPYT

SEQ ID NO: 6856 - protein, 15 aa, Homo sapiens
  Heavy chain CDR3 for antibody 3428 (IGHV1-46)
AREKYYGSATYPFDS

SEQ ID NO: 6857 - protein, 9 aa, Homo sapiens
  Light chain CDR3 for antibody 3429 (IGKV1D-17)
LQHNSYPYT

SEQ ID NO: 6858 - protein, 10 aa, Homo sapiens
  Heavy chain CDR3 for antibody 3429 (IGHV3-33)
ASASTDAMDV

SEQ ID NO: 6859 - protein, 9 aa, Homo sapiens
  Light chain CDR3 for antibody 3430 (IGKV1-9)
HQLNSYPYT

SEQ ID NO: 6860 - protein, 15 aa, Homo sapiens
  Heavy chain CDR3 for antibody 3430 (IGHV1-46)
AREKYHGSGSYPFDS

SEQ ID NO: 6861 - protein, 9 aa, Homo sapiens
  Light chain CDR3 for antibody 3431 (IGKV1D-17)
LQHDSYPYT

SEQ ID NO: 6862 - protein, 10 aa, Homo sapiens
  Heavy chain CDR3 for antibody 3431 (IGHV3-23)
AIESTDGMDF

SEQ ID NO: 6863 - protein, 9 aa, Homo sapiens
  Light chain CDR3 for antibody 3432 (IGKV1D-17)
LQHDSYPYT

SEQ ID NO: 6864 - protein, 10 aa, Homo sapiens
  Heavy chain CDR3 for antibody 3432 (IGHV3-33)
AREATDGMEV

SEQ ID NO: 6865 - protein, 9 aa, Homo sapiens
  Light chain CDR3 for antibody 3433 (IGKV1-9)
QQLNSHPFT

SEQ ID NO: 6866 - protein, 17 aa, Homo sapiens
  Heavy chain CDR3 for antibody 3433 (IGHV3-33)
AREITRGRGDNYYGMDV

SEQ ID NO: 6867 - protein, 9 aa, Homo sapiens
  Light chain CDR3 for antibody 3434 (IGKV1-17)
LQHNSYPYT

SEQ ID NO: 6868 - protein, 10 aa, Homo sapiens
  Heavy chain CDR3 for antibody 3434 (IGHV3-64)
ASESGDGFDY

SEQ ID NO: 6869 - protein, 9 aa, Homo sapiens
  Light chain CDR3 for antibody 3435 (IGKV1D-17)
LQHNSYPYT

SEQ ID NO: 6870 - protein, 14 aa, Homo sapiens
  Heavy chain CDR3 for antibody 3435 (IGHV3-23)
AKERAVAGLNWFDP

SEQ ID NO: 6871 - protein, 9 aa, Homo sapiens
  Light chain CDR3 for antibody 3436 (IGKV3D-20)
QQYGSSPWT

SEQ ID NO: 6872 - protein, 18 aa, Homo sapiens
  Heavy chain CDR3 for antibody 3436 (IGHV3-11)
ARYGDPERDYYYYYGMDV

SEQ ID NO: 6873 - protein, 9 aa, Homo sapiens
  Light chain CDR3 for antibody 3437 (IGKV1D-17)
LQHNSYPYT

SEQ ID NO: 6874 - protein, 10 aa, Homo sapiens
  Heavy chain CDR3 for antibody 3437 (IGHV3-30)
AGEAADGMDV

SEQ ID NO: 6875 - protein, 9 aa, Homo sapiens
  Light chain CDR3 for antibody 3438 (IGKV1D-16)
QQYNSYPYT

SEQ ID NO: 6876 - protein, 14 aa, Homo sapiens
  Heavy chain CDR3 for antibody 3438 (IGHV3-33)
ARENIAVVQGGMDV

SEQ ID NO: 6877 - protein, 9 aa, Homo sapiens
  Light chain CDR3 for antibody 3439 (IGKV1-6)
LQDYNYPYT

SEQ ID NO: 6878 - protein, 17 aa, Homo sapiens
  Heavy chain CDR3 for antibody 3439 (IGHV3-23)
AKGRGARGFYYYYGMDV

SEQ ID NO: 6879 - protein, 9 aa, Homo sapiens
  Light chain CDR3 for antibody 3440 (IGKV1-9)
QQLNSYPWT

SEQ ID NO: 6880 - protein, 14 aa, Homo sapiens
  Heavy chain CDR3 for antibody 3440 (IGHV3-23)
AKRDYGSGSSYFQH

SEQ ID NO: 6881 - protein, 9 aa, Homo sapiens
  Light chain CDR3 for antibody 3441 (IGKV1-9)
QQLNSYPYT

SEQ ID NO: 6882 - protein, 13 aa, Homo sapiens
  Heavy chain CDR3 for antibody 3441 (IGHV6-1)
ARGKFDYYYGMDV

SEQ ID NO: 6883 - protein, 9 aa, Homo sapiens
  Light chain CDR3 for antibody 3442 (IGKV1-6)
LQDYNYLYT

SEQ ID NO: 6884 - protein, 17 aa, Homo sapiens
  Heavy chain CDR3 for antibody 3442 (IGHV4-39)
ARKYYDILTGTPLAFDI

SEQ ID NO: 6885 - protein, 9 aa, Homo sapiens
  Light chain CDR3 for antibody 3443 (IGKV1-12)
QQANSFPWT

SEQ ID NO: 6886 - protein, 15 aa, Homo sapiens
  Heavy chain CDR3 for antibody 3443 (IGHV1-46)
AREKYYGSGSYPFDY

SEQ ID NO: 6887 - protein, 9 aa, Homo sapiens
  Light chain CDR3 for antibody 3444 (IGKV1D-17)
LQHNSYPYT

SEQ ID NO: 6888 - protein, 10 aa, Homo sapiens
  Heavy chain CDR3 for antibody 3444 (IGHV3-33)
ARDSTAGMAV

SEQ ID NO: 6889 - protein, 9 aa, Homo sapiens
  Light chain CDR3 for antibody 3445 (IGKV3-15)
QQYNNWPRT

SEQ ID NO: 6890 - protein, 17 aa, Homo sapiens
  Heavy chain CDR3 for antibody 3445 (IGHV3-33)
AREITMVRGDNYYGMDV

SEQ ID NO: 6891 - protein, 9 aa, Homo sapiens
  Light chain CDR3 for antibody 3446 (IGKV1-39)
QQSYSTPYT

SEQ ID NO: 6892 - protein, 13 aa, Homo sapiens
  Heavy chain CDR3 for antibody 3446 (IGHV1-24)
ATDYGDYRYYFDY

SEQ ID NO: 6893 - protein, 9 aa, Homo sapiens
  Light chain CDR3 for antibody 3447 (IGKV1-9)
QQLNSYPFT

SEQ ID NO: 6894 - protein, 17 aa, Homo sapiens
  Heavy chain CDR3 for antibody 3447 (IGHV3-33)
AREIAMVQGDSYYGMDV

SEQ ID NO: 6895 - protein, 9 aa, Homo sapiens
  Light chain CDR3 for antibody 3448 (IGKV1-9)
QQLNSHPFT

SEQ ID NO: 6896 - protein, 17 aa, Homo sapiens
  Heavy chain CDR3 for antibody 3448 (IGHV3-33)
ARAITMFRGDNYYGMDV

SEQ ID NO: 6897 - protein, 9 aa, Homo sapiens
  Light chain CDR3 for antibody 3449 (IGKV1-9)
QQLNSYPFT

SEQ ID NO: 6898 - protein, 17 aa, Homo sapiens
  Heavy chain CDR3 for antibody 3449 (IGHV3-33)
AREITMVRGDNYYGLEG

SEQ ID NO: 6899 - protein, 9 aa, Homo sapiens
  Light chain CDR3 for antibody 3450 (IGKV1-9)
QQLNGYPYT

SEQ ID NO: 6900 - protein, 15 aa, Homo sapiens
  Heavy chain CDR3 for antibody 3450 (IGHV1-46)
AREKYYGSGTYPFDY

SEQ ID NO: 6901 - protein, 9 aa, Homo sapiens
  Light chain CDR3 for antibody 3451 (IGKV1D-17)
LQHNSYPYT

SEQ ID NO: 6902 - protein, 10 aa, Homo sapiens
  Heavy chain CDR3 for antibody 3451 (IGHV3-33)
ASESADGMDA

SEQ ID NO: 6903 - protein, 9 aa, Homo sapiens
  Light chain CDR3 for antibody 3452 (IGKV1-8)
QQYYSYPLT

SEQ ID NO: 6904 - protein, 10 aa, Homo sapiens
  Heavy chain CDR3 for antibody 3452 (IGHV3-33)
ARESTDGMDV

SEQ ID NO: 6905 - protein, 9 aa, Homo sapiens
  Light chain CDR3 for antibody 3453 (IGKV1D-17)
LQHNSYPYT

SEQ ID NO: 6906 - protein, 16 aa, Homo sapiens
  Heavy chain CDR3 for antibody 3453 (IGHV3-33)
ARDRDIVATGEYYFDY

SEQ ID NO: 6907 - protein, 9 aa, Homo sapiens
  Light chain CDR3 for antibody 3454 (IGKV1-6)
LQDYNYPWT

SEQ ID NO: 6908 - protein, 13 aa, Homo sapiens
  Heavy chain CDR3 for antibody 3454 (IGHV3-20)
AREGGWGPWSFDL

SEQ ID NO: 6909 - protein, 9 aa, Homo sapiens
  Light chain CDR3 for antibody 3455 (IGKV1-17)
LQHNSYPYT

SEQ ID NO: 6910 - protein, 10 aa, Homo sapiens
  Heavy chain CDR3 for antibody 3455 (IGHV3-20)
AREGISSFDY

SEQ ID NO: 6911 - protein, 9 aa, Homo sapiens
  Light chain CDR3 for antibody 3456 (IGKV1-9)
QQLNSYPYT

SEQ ID NO: 6912 - protein, 15 aa, Homo sapiens
  Heavy chain CDR3 for antibody 3456 (IGHV1-46)
SREKYYGSGTYPFDS

SEQ ID NO: 6913 - protein, 10 aa, Homo sapiens
  Light chain CDR3 for antibody 3457 (IGKV1-9)
QQLNSYPPYT

SEQ ID NO: 6914 - protein, 10 aa, Homo sapiens
  Heavy chain CDR3 for antibody 3457 (IGHV3-53)
ARDYYGVLDY

SEQ ID NO: 6915 - protein, 9 aa, Homo sapiens
  Light chain CDR3 for antibody 3458 (IGKV1-9)
LQHNSYPYT

SEQ ID NO: 6916 - protein, 10 aa, Homo sapiens
  Heavy chain CDR3 for antibody 3458 (IGHV3-33)
AIESTDAMNV

SEQ ID NO: 6917 - protein, 9 aa, Homo sapiens
  Light chain CDR3 for antibody 3459 (IGKV1-6)
LQDYNYPWT

SEQ ID NO: 6918 - protein, 10 aa, Homo sapiens
  Heavy chain CDR3 for antibody 3459 (IGHV3-33)
ARESTDGMDV

SEQ ID NO: 6919 - protein, 9 aa, Homo sapiens
  Light chain CDR3 for antibody 3460 (IGKV1-9)
QQLNSHPFT

SEQ ID NO: 6920 - protein, 17 aa, Homo sapiens
  Heavy chain CDR3 for antibody 3460 (IGHV3-30)
AREITVVRGDNYYGMDV

SEQ ID NO: 6921 - protein, 9 aa, Homo sapiens
  Light chain CDR3 for antibody 3461 (IGKV1-9)
QQLNSYPPT

SEQ ID NO: 6922 - protein, 18 aa, Homo sapiens
  Heavy chain CDR3 for antibody 3461 (IGHV3-11)
ARDVMVRGVMDYYYGMDV

SEQ ID NO: 6923 - protein, 9 aa, Homo sapiens
  Light chain CDR3 for antibody 3462 (IGKV1D-17)
LQHNSYPYT

SEQ ID NO: 6924 - protein, 10 aa, Homo sapiens
  Heavy chain CDR3 for antibody 3462 (IGHV3-33)
ARESSDGMDA

SEQ ID NO: 6925 - protein, 8 aa, Homo sapiens
  Light chain CDR3 for antibody 3463 (IGKV1-5)
QQYNSYWT

SEQ ID NO: 6926 - protein, 13 aa, Homo sapiens
  Heavy chain CDR3 for antibody 3463 (IGHV1-24)
ATTYSGYAYYFDY

SEQ ID NO: 6927 - protein, 9 aa, Homo sapiens
  Light chain CDR3 for antibody 3464 (IGKV6-21)
HQSSSLPYT

SEQ ID NO: 6928 - protein, 13 aa, Homo sapiens
  Heavy chain CDR3 for antibody 3464 (IGHV1-18)
AREGGSYYVSFDY

SEQ ID NO: 6929 - protein, 9 aa, Homo sapiens
  Light chain CDR3 for antibody 3465 (IGKV1-9)
QQLNSYPYT

SEQ ID NO: 6930 - protein, 15 aa, Homo sapiens
  Heavy chain CDR3 for antibody 3465 (IGHV1-46)
AREKYYGAGSYPIDY

SEQ ID NO: 6931 - protein, 9 aa, Homo sapiens
  Light chain CDR3 for antibody 3466 (IGKV1-9)
QQFNSHPFT

SEQ ID NO: 6932 - protein, 17 aa, Homo sapiens
  Heavy chain CDR3 for antibody 3466 (IGHV3-33)
AREIAMVRGDNYYGFDV

SEQ ID NO: 6933 - protein, 9 aa, Homo sapiens
  Light chain CDR3 for antibody 3467 (IGKV1-9)
HQLNSYPYT

SEQ ID NO: 6934 - protein, 15 aa, Homo sapiens
  Heavy chain CDR3 for antibody 3467 (IGHV1-46)
AREKYYGSGSYPFAY

SEQ ID NO: 6935 - protein, 9 aa, Homo sapiens
  Light chain CDR3 for antibody 3468 (IGKV1-17)
QQYNSYPRT

SEQ ID NO: 6936 - protein, 16 aa, Homo sapiens
  Heavy chain CDR3 for antibody 3468 (IGHV3-23)
AKEYYYGSGSYSLFDY

SEQ ID NO: 6937 - protein, 9 aa, Homo sapiens
  Light chain CDR3 for antibody 3469 (IGKV1-9)
QQLNSHPFT

SEQ ID NO: 6938 - protein, 17 aa, Homo sapiens
  Heavy chain CDR3 for antibody 3469 (IGHV3-33)
AREITMVRGDNYYGMDG

SEQ ID NO: 6939 - protein, 9 aa, Homo sapiens
  Light chain CDR3 for antibody 3470 (IGKV1D-17)
LQHNSYPYT

SEQ ID NO: 6940 - protein, 10 aa, Homo sapiens
  Heavy chain CDR3 for antibody 3470 (IGHV3-66)
AGETTDGMDA

SEQ ID NO: 6941 - protein, 9 aa, Homo sapiens
  Light chain CDR3 for antibody 3471 (IGKV1-9)
QQLNSYPYT

SEQ ID NO: 6942 - protein, 8 aa, Homo sapiens
  Heavy chain CDR3 for antibody 3471 (IGHV4-59)
ASGACFDY

SEQ ID NO: 6943 - protein, 9 aa, Homo sapiens
  Light chain CDR3 for antibody 3472 (IGKV1-9)
QHLNSYPFT

SEQ ID NO: 6944 - protein, 17 aa, Homo sapiens
  Heavy chain CDR3 for antibody 3472 (IGHV3-33)
AREITMVRGYNYYGIDV

SEQ ID NO: 6945 - protein, 9 aa, Homo sapiens
  Light chain CDR3 for antibody 3473 (IGKV1D-17)
LQHDSYPYT

SEQ ID NO: 6946 - protein, 10 aa, Homo sapiens
  Heavy chain CDR3 for antibody 3473 (IGHV3-33)
ARASPDGMDV

SEQ ID NO: 6947 - protein, 9 aa, Homo sapiens
  Light chain CDR3 for antibody 3474 (IGKV1-9)
QQLNSYPFT

SEQ ID NO: 6948 - protein, 17 aa, Homo sapiens
  Heavy chain CDR3 for antibody 3474 (IGHV3-33)
VREITMVRGDNYYGLDA

SEQ ID NO: 6949 - protein, 9 aa, Homo sapiens
  Light chain CDR3 for antibody 3475 (IGKV1-9)
QQLNSYPYT

SEQ ID NO: 6950 - protein, 15 aa, Homo sapiens
  Heavy chain CDR3 for antibody 3475 (IGHV1-46)
AREKYYGSGSSPFDS

SEQ ID NO: 6951 - protein, 9 aa, Homo sapiens
  Light chain CDR3 for antibody 3476 (IGKV1-9)
QQFNSHPFT

SEQ ID NO: 6952 - protein, 15 aa, Homo sapiens
  Heavy chain CDR3 for antibody 3476 (IGHV1-46)
VREKYYGSGSYPFDY

SEQ ID NO: 6953 - protein, 9 aa, Homo sapiens
  Light chain CDR3 for antibody 3477 (IGKV1-9)
QQLNSYPYT

SEQ ID NO: 6954 - protein, 15 aa, Homo sapiens
  Heavy chain CDR3 for antibody 3477 (IGHV1-46)
EREKYYGSGSYPFED

SEQ ID NO: 6955 - protein, 9 aa, Homo sapiens
  Light chain CDR3 for antibody 3478 (IGKV1D-17)
QQLNSYPYT

SEQ ID NO: 6956 - protein, 12 aa, Homo sapiens
  Heavy chain CDR3 for antibody 3478 (IGHV3-13)
ARGVFYYYGMDV

SEQ ID NO: 6957 - protein, 9 aa, Homo sapiens
  Light chain CDR3 for antibody 3479 (IGKV1-9)
QHLNSHPFT

SEQ ID NO: 6958 - protein, 17 aa, Homo sapiens
  Heavy chain CDR3 for antibody 3479 (IGHV3-33)
AREITMVRGDTYSGMDV

SEQ ID NO: 6959 - protein, 9 aa, Homo sapiens
  Light chain CDR3 for antibody 3480 (IGKV1-9)
QQLNSYPYT

SEQ ID NO: 6960 - protein, 13 aa, Homo sapiens
  Heavy chain CDR3 for antibody 3480 (IGHV1-24)
ATTYSGYAYYFDY

SEQ ID NO: 6961 - protein, 9 aa, Homo sapiens
  Light chain CDR3 for antibody 3481 (IGKV1-9)
QHLNSHPFT

SEQ ID NO: 6962 - protein, 17 aa, Homo sapiens
  Heavy chain CDR3 for antibody 3481 (IGHV3-33)
AREITMVRGDNYDGMEV

SEQ ID NO: 6963 - protein, 9 aa, Homo sapiens
  Light chain CDR3 for antibody 3482 (IGKV1-9)
QQLNSYPFT

SEQ ID NO: 6964 - protein, 17 aa, Homo sapiens
  Heavy chain CDR3 for antibody 3482 (IGHV3-33)
ARENTMVRGDNYSGLDV

SEQ ID NO: 6965 - protein, 9 aa, Homo sapiens
  Light chain CDR3 for antibody 3483 (IGKV1-9)
QQLNSYPFT

SEQ ID NO: 6966 - protein, 17 aa, Homo sapiens
  Heavy chain CDR3 for antibody 3483 (IGHV3-33)
ARESTMVRGDNYYGMDD

SEQ ID NO: 6967 - protein, 9 aa, Homo sapiens
  Light chain CDR3 for antibody 3484 (IGKV1-9)
QQLNGYPYT

SEQ ID NO: 6968 - protein, 15 aa, Homo sapiens
  Heavy chain CDR3 for antibody 3484 (IGHV1-46)
AREKDYGSGSYPFDD

SEQ ID NO: 6969 - protein, 9 aa, Homo sapiens
  Light chain CDR3 for antibody 3485 (IGKV1-6)
LQDYNYPYT

SEQ ID NO: 6970 - protein, 17 aa, Homo sapiens
  Heavy chain CDR3 for antibody 3485 (IGHV3-33)
ARDRATVTLYYYYGMDV

SEQ ID NO: 6971 - protein, 9 aa, Homo sapiens
  Light chain CDR3 for antibody 3486 (IGKV6-21)
HQSSSLPWT

SEQ ID NO: 6972 - protein, 9 aa, Homo sapiens
  Heavy chain CDR3 for antibody 3486 (IGHV3-49)
TRVGVGFDY

SEQ ID NO: 6973 - protein, 9 aa, Homo sapiens
  Light chain CDR3 for antibody 3487 (IGKV1-9)
QHLNSHPFT

SEQ ID NO: 6974 - protein, 9 aa, Homo sapiens
  Heavy chain CDR3 for antibody 3487 (IGHV3-66)
AREGAGIDY

SEQ ID NO: 6975 - protein, 9 aa, Homo sapiens
  Light chain CDR3 for antibody 3488 (IGKV1-9)
QQLNSHPFT

SEQ ID NO: 6976 - protein, 17 aa, Homo sapiens
  Heavy chain CDR3 for antibody 3488 (IGHV3-33)
AREITMVRGDNCYGMEV

SEQ ID NO: 6977 - protein, 9 aa, Homo sapiens
  Light chain CDR3 for antibody 3489 (IGKV1-9)
QQLNSYPFT

SEQ ID NO: 6978 - protein, 17 aa, Homo sapiens
  Heavy chain CDR3 for antibody 3489 (IGHV3-33)
AREITKVRGYNYYGLDV

SEQ ID NO: 6979 - protein, 9 aa, Homo sapiens
  Light chain CDR3 for antibody 3490 (IGKV1D-17)
QQLNSYPFT

SEQ ID NO: 6980 - protein, 17 aa, Homo sapiens
  Heavy chain CDR3 for antibody 3490 (IGHV3-33)
AREITMVRGDNYYGLDF

SEQ ID NO: 6981 - protein, 9 aa, Homo sapiens
  Light chain CDR3 for antibody 3491 (IGKV1-9)
QQLNSYPFT

SEQ ID NO: 6982 - protein, 17 aa, Homo sapiens
  Heavy chain CDR3 for antibody 3491 (IGHV3-30)
AREITLVRVDNYYAMDV

SEQ ID NO: 6983 - protein, 9 aa, Homo sapiens
  Light chain CDR3 for antibody 3492 (IGKV3-15)
QQYNNWPRT

SEQ ID NO: 6984 - protein, 13 aa, Homo sapiens
  Heavy chain CDR3 for antibody 3492 (IGHV3-33)
ARDDSSGWYYFDY

SEQ ID NO: 6985 - protein, 9 aa, Homo sapiens
  Light chain CDR3 for antibody 3493 (IGKV1-9)
QQLISYPYT

SEQ ID NO: 6986 - protein, 15 aa, Homo sapiens
  Heavy chain CDR3 for antibody 3493 (IGHV1-46)
AREKYYGSESYPLDS

SEQ ID NO: 6987 - protein, 9 aa, Homo sapiens
  Light chain CDR3 for antibody 3494 (IGKV1-12)
QQANSFPWT

SEQ ID NO: 6988 - protein, 17 aa, Homo sapiens
  Heavy chain CDR3 for antibody 3494 (IGHV3-33)
AREITMVRGDNYYGMDV

SEQ ID NO: 6989 - protein, 9 aa, Homo sapiens
  Light chain CDR3 for antibody 3495 (IGKV1-9)
QQLNSHPFT

SEQ ID NO: 6990 - protein, 17 aa, Homo sapiens
  Heavy chain CDR3 for antibody 3495 (IGHV3-33)
AREITMVRVDNYYGMDF

SEQ ID NO: 6991 - protein, 9 aa, Homo sapiens
  Light chain CDR3 for antibody 3496 (IGKV1-9)
QQLISYPYT

SEQ ID NO: 6992 - protein, 15 aa, Homo sapiens
  Heavy chain CDR3 for antibody 3496 (IGHV1-46)
AREKYYGSGSSPFDS

SEQ ID NO: 6993 - protein, 9 aa, Homo sapiens
  Light chain CDR3 for antibody 3497 (IGKV1D-16)
QQYNSYPPT

SEQ ID NO: 6994 - protein, 16 aa, Homo sapiens
  Heavy chain CDR3 for antibody 3497 (IGHV3-33)
ARDQGAVGPYYYGMDV

SEQ ID NO: 6995 - protein, 9 aa, Homo sapiens
  Light chain CDR3 for antibody 3498 (IGKV1D-17)
LQHNSYPYT

SEQ ID NO: 6996 - protein, 10 aa, Homo sapiens
  Heavy chain CDR3 for antibody 3498 (IGHV3-33)
ARESTDGMEA

SEQ ID NO: 6997 - protein, 9 aa, Homo sapiens
  Light chain CDR3 for antibody 3499 (IGKV1-9)
LQHNSYPYT

SEQ ID NO: 6998 - protein, 10 aa, Homo sapiens
  Heavy chain CDR3 for antibody 3499 (IGHV3-33)
AREATDGIDD

SEQ ID NO: 6999 - protein, 9 aa, Homo sapiens
  Light chain CDR3 for antibody 3500 (IGKV1D-17)
LQHNSYPYT

SEQ ID NO: 7000 - protein, 10 aa, Homo sapiens
  Heavy chain CDR3 for antibody 3500 (IGHV3-33)
ARESSYGMDV

SEQ ID NO: 7001 - protein, 9 aa, Homo sapiens
  Light chain CDR3 for antibody 3501 (IGKV1-6)
LQDYNYPWT

SEQ ID NO: 7002 - protein, 17 aa, Homo sapiens
  Heavy chain CDR3 for antibody 3501 (IGHV3-33)
AREITMVRGDNYYGMDV

SEQ ID NO: 7003 - protein, 9 aa, Homo sapiens
  Light chain CDR3 for antibody 3502 (IGKV1D-17)
LQHNSYPYT

SEQ ID NO: 7004 - protein, 10 aa, Homo sapiens
  Heavy chain CDR3 for antibody 3502 (IGHV3-64)
ARDSGEGFEY

SEQ ID NO: 7005 - protein, 9 aa, Homo sapiens
  Light chain CDR3 for antibody 3503 (IGKV1D-17)
LQHNSYPYT

SEQ ID NO: 7006 - protein, 10 aa, Homo sapiens
  Heavy chain CDR3 for antibody 3503 (IGHV3-33)
ARESTNGMAA

SEQ ID NO: 7007 - protein, 9 aa, Homo sapiens
  Light chain CDR3 for antibody 3504 (IGKV6-21)
HQSSSLPYT

SEQ ID NO: 7008 - protein, 16 aa, Homo sapiens
  Heavy chain CDR3 for antibody 3504 (IGHV1-18)
AREYYGSGSYYIYFDY

SEQ ID NO: 7009 - protein, 9 aa, Homo sapiens
  Light chain CDR3 for antibody 3505 (IGKV1-9)
QQFNSHPFT

SEQ ID NO: 7010 - protein, 17 aa, Homo sapiens
  Heavy chain CDR3 for antibody 3505 (IGHV3-33)
EREITMVRGENYYGLDV

SEQ ID NO: 7011 - protein, 9 aa, Homo sapiens
  Light chain CDR3 for antibody 3506 (IGKV1D-17)
LQHNSYPYT

SEQ ID NO: 7012 - protein, 11 aa, Homo sapiens
  Heavy chain CDR3 for antibody 3506 (IGHV4-4)
ARATMVRNFDY

SEQ ID NO: 7013 - protein, 9 aa, Homo sapiens
  Light chain CDR3 for antibody 3507 (IGKV1-9)
HQLISYPYT

SEQ ID NO: 7014 - protein, 15 aa, Homo sapiens
  Heavy chain CDR3 for antibody 3507 (IGHV1-46)
AREKYYGAGSYPLDY

SEQ ID NO: 7015 - protein, 9 aa, Homo sapiens
  Light chain CDR3 for antibody 3508 (IGKV1-9)
QQLNSYPFT

SEQ ID NO: 7016 - protein, 17 aa, Homo sapiens
  Heavy chain CDR3 for antibody 3508 (IGHV3-30)
AREIAMLRGDNYYGLDV

SEQ ID NO: 7017 - protein, 9 aa, Homo sapiens
  Light chain CDR3 for antibody 3509 (IGKV1-9)
QQFNSYPFT

SEQ ID NO: 7018 - protein, 17 aa, Homo sapiens
  Heavy chain CDR3 for antibody 3509 (IGHV3-33)
GREITMVRGYNYYGMAV

SEQ ID NO: 7019 - protein, 9 aa, Homo sapiens
  Light chain CDR3 for antibody 3510 (IGKV1-6)
LQDYNYPWT

SEQ ID NO: 7020 - protein, 17 aa, Homo sapiens
  Heavy chain CDR3 for antibody 3510 (IGHV3-33)
AREGPYSSSWYGDWFDP

SEQ ID NO: 7021 - protein, 9 aa, Homo sapiens
  Light chain CDR3 for antibody 3511 (IGKV1-9)
QQLNSYPFT

SEQ ID NO: 7022 - protein, 17 aa, Homo sapiens
  Heavy chain CDR3 for antibody 3511 (IGHV3-11)
ARKITMFRGDNYYGLDV

SEQ ID NO: 7023 - protein, 9 aa, Homo sapiens
  Light chain CDR3 for antibody 3512 (IGKV1-9)
QQLNSYPFT

SEQ ID NO: 7024 - protein, 16 aa, Homo sapiens
  Heavy chain CDR3 for antibody 3512 (IGHV3-11)
ARDRDIVATGEYYFDY

SEQ ID NO: 7025 - protein, 9 aa, Homo sapiens
  Light chain CDR3 for antibody 3513 (IGKV1-9)
QHLNSHPFT

SEQ ID NO: 7026 - protein, 17 aa, Homo sapiens
  Heavy chain CDR3 for antibody 3513 (IGHV3-33)
AREITMVRGENYYGMDV

SEQ ID NO: 7027 - protein, 9 aa, Homo sapiens
  Light chain CDR3 for antibody 3514 (IGKV1-12)
QQANSFPWT

SEQ ID NO: 7028 - protein, 10 aa, Homo sapiens
  Heavy chain CDR3 for antibody 3514 (IGHV1-18)
ARESTDGMDV

SEQ ID NO: 7029 - protein, 9 aa, Homo sapiens
  Light chain CDR3 for antibody 3515 (IGKV1-39)
QQSYSTPYT

SEQ ID NO: 7030 - protein, 14 aa, Homo sapiens
  Heavy chain CDR3 for antibody 3515 (IGHV3-23)
AKDQIVATIEYFQH

SEQ ID NO: 7031 - protein, 9 aa, Homo sapiens
  Light chain CDR3 for antibody 3516 (IGKV1D-17)
LQHNSYPYT

SEQ ID NO: 7032 - protein, 10 aa, Homo sapiens
  Heavy chain CDR3 for antibody 3516 (IGHV3-30)
TRESTDAMHA

SEQ ID NO: 7033 - protein, 9 aa, Homo sapiens
  Light chain CDR3 for antibody 3517 (IGKV1-9)
QQLISYPYT

SEQ ID NO: 7034 - protein, 15 aa, Homo sapiens
  Heavy chain CDR3 for antibody 3517 (IGHV1-46)
AREKYYGSGSDPFDS

SEQ ID NO: 7035 - protein, 9 aa, Homo sapiens
  Light chain CDR3 for antibody 3518 (IGKV1D-16)
QQYNSYPYT

SEQ ID NO: 7036 - protein, 17 aa, Homo sapiens
  Heavy chain CDR3 for antibody 3518 (IGHV3-33)
AREITMVRGDNYYGMDV

SEQ ID NO: 7037 - protein, 9 aa, Homo sapiens
  Light chain CDR3 for antibody 3519 (IGKV1-9)
QQLNSHPFT

SEQ ID NO: 7038 - protein, 16 aa, Homo sapiens
  Heavy chain CDR3 for antibody 3519 (IGHV1-18)
AREGDTMVRGVIAFDY

SEQ ID NO: 7039 - protein, 9 aa, Homo sapiens
  Light chain CDR3 for antibody 3520 (IGKV3D-20)
QQYGSSPWT

SEQ ID NO: 7040 - protein, 16 aa, Homo sapiens
  Heavy chain CDR3 for antibody 3520 (IGHV3-33)
ARGDYDILTGLDYIDY

SEQ ID NO: 7041 - protein, 9 aa, Homo sapiens
  Light chain CDR3 for antibody 3521 (IGKV1-9)
QQLNSYPFT

SEQ ID NO: 7042 - protein, 17 aa, Homo sapiens
  Heavy chain CDR3 for antibody 3521 (IGHV3-71)
AREITMAGGDNYYGLDV

SEQ ID NO: 7043 - protein, 9 aa, Homo sapiens
  Light chain CDR3 for antibody 3522 (IGKV1D-17)
LQHNSYPYT

SEQ ID NO: 7044 - protein, 10 aa, Homo sapiens
  Heavy chain CDR3 for antibody 3522 (IGHV3-33)
AGEATDAMDV

SEQ ID NO: 7045 - protein, 9 aa, Homo sapiens
  Light chain CDR3 for antibody 3523 (IGKV1D-17)
LQHNSYPYT

SEQ ID NO: 7046 - protein, 13 aa, Homo sapiens
  Heavy chain CDR3 for antibody 3523 (IGHV3-33)
ARDWYYGSGSPYY

SEQ ID NO: 7047 - protein, 9 aa, Homo sapiens
  Light chain CDR3 for antibody 3524 (IGKV1-9)
QQLNSYPFT

SEQ ID NO: 7048 - protein, 17 aa, Homo sapiens
  Heavy chain CDR3 for antibody 3524 (IGHV3-33)
ARESTLVRGENYYGMDV

SEQ ID NO: 7049 - protein, 9 aa, Homo sapiens
  Light chain CDR3 for antibody 3525 (IGKV1-9)
QQFNSHPFT

SEQ ID NO: 7050 - protein, 10 aa, Homo sapiens
  Heavy chain CDR3 for antibody 3525 (IGHV3-33)
AREAVAGFDY

SEQ ID NO: 7051 - protein, 9 aa, Homo sapiens
  Light chain CDR3 for antibody 3526 (IGKV1-17)
LQHNSYPPT

SEQ ID NO: 7052 - protein, 21 aa, Homo sapiens
  Heavy chain CDR3 for antibody 3526 (IGHV3-11)
ARDRNYDILTGYYKGENYFDY

SEQ ID NO: 7053 - protein, 9 aa, Homo sapiens
  Light chain CDR3 for antibody 3527 (IGKV1D-17)
LQHNSYPYT

SEQ ID NO: 7054 - protein, 15 aa, Homo sapiens
  Heavy chain CDR3 for antibody 3527 (IGHV1-46)
AREKYYGSGSSPFDY

SEQ ID NO: 7055 - protein, 9 aa, Homo sapiens
  Light chain CDR3 for antibody 3528 (IGKV1-9)
QQLNSFPFT

SEQ ID NO: 7056 - protein, 17 aa, Homo sapiens
  Heavy chain CDR3 for antibody 3528 (IGHV3-74)
AREIPMVRGDNYSGMDV

SEQ ID NO: 7057 - protein, 9 aa, Homo sapiens
  Light chain CDR3 for antibody 3529 (IGKV1-27)
QKYNSAPLT

SEQ ID NO: 7058 - protein, 17 aa, Homo sapiens
  Heavy chain CDR3 for antibody 3529 (IGHV3-33)
AREITMVRGDNYYGMDV

SEQ ID NO: 7059 - protein, 9 aa, Homo sapiens
  Light chain CDR3 for antibody 3530 (IGKV1-9)
QHLNSHPFT

SEQ ID NO: 7060 - protein, 17 aa, Homo sapiens
  Heavy chain CDR3 for antibody 3530 (IGHV3-33)
AREIAMVRGDNYYGMDV

SEQ ID NO: 7061 - protein, 9 aa, Homo sapiens
  Light chain CDR3 for antibody 3531 (IGKV1-9)
QHLNSHPFT

SEQ ID NO: 7062 - protein, 10 aa, Homo sapiens
  Heavy chain CDR3 for antibody 3531 (IGHV3-33)
ARDSTYGMDV

SEQ ID NO: 7063 - protein, 9 aa, Homo sapiens
  Light chain CDR3 for antibody 3532 (IGKV1-9)
QQLISYPYT

SEQ ID NO: 7064 - protein, 15 aa, Homo sapiens
  Heavy chain CDR3 for antibody 3532 (IGHV1-46)
AREKDYGAGRYPFDS

SEQ ID NO: 7065 - protein, 9 aa, Homo sapiens
  Light chain CDR3 for antibody 3533 (IGKV1-9)
QQLISYPYT

SEQ ID NO: 7066 - protein, 5 aa, Homo sapiens
  Heavy chain CDR3 for antibody 3533 (IGHV1-46)
AREKY

SEQ ID NO: 7067 - protein, 9 aa, Homo sapiens
  Light chain CDR3 for antibody 3534 (IGKV1-9)
QQLNGYPYT

SEQ ID NO: 7068 - protein, 15 aa, Homo sapiens
  Heavy chain CDR3 for antibody 3534 (IGHV1-46)
AREDYYGSGSYPFDY

SEQ ID NO: 7069 - protein, 9 aa, Homo sapiens
  Light chain CDR3 for antibody 3535 (IGKV1D-17)
LQHNSYPYT

SEQ ID NO: 7070 - protein, 17 aa, Homo sapiens
  Heavy chain CDR3 for antibody 3535 (IGHV3-23)
AKGRGARGFYYYYGMDV

SEQ ID NO: 7071 - protein, 9 aa, Homo sapiens
  Light chain CDR3 for antibody 3536 (IGKV1-9)
QQLNSYPYT

SEQ ID NO: 7072 - protein, 15 aa, Homo sapiens
  Heavy chain CDR3 for antibody 3536 (IGHV1-46)
AREKYYGAGSYPLDS

SEQ ID NO: 7073 - protein, 9 aa, Homo sapiens
  Light chain CDR3 for antibody 3537 (IGKV1-9)
QQLNSYPFT

SEQ ID NO: 7074 - protein, 17 aa, Homo sapiens
  Heavy chain CDR3 for antibody 3537 (IGHV3-33)
AREITMVRGENYYGMDD

SEQ ID NO: 7075 - protein, 9 aa, Homo sapiens
  Light chain CDR3 for antibody 3538 (IGKV1-9)
QHLNSHPFT

SEQ ID NO: 7076 - protein, 17 aa, Homo sapiens
  Heavy chain CDR3 for antibody 3538 (IGHV3-33)
AREITMFRGENYYGLDV

SEQ ID NO: 7077 - protein, 9 aa, Homo sapiens
  Light chain CDR3 for antibody 3539 (IGKV1D-17)
LQHDSYPYT

SEQ ID NO: 7078 - protein, 10 aa, Homo sapiens
  Heavy chain CDR3 for antibody 3539 (IGHV3-33)
AGESTDGMDV

SEQ ID NO: 7079 - protein, 9 aa, Homo sapiens
  Light chain CDR3 for antibody 3540 (IGKV1-9)
HQLISYPYT

SEQ ID NO: 7080 - protein, 15 aa, Homo sapiens
  Heavy chain CDR3 for antibody 3540 (IGHV1-46)
AREKYYGSGSYPFEY

SEQ ID NO: 7081 - protein, 9 aa, Homo sapiens
  Light chain CDR3 for antibody 3541 (IGKV1-9)
QQLNSYPYT

SEQ ID NO: 7082 - protein, 15 aa, Homo sapiens
  Heavy chain CDR3 for antibody 3541 (IGHV1-46)
AREKCSGSGSYPFDS

SEQ ID NO: 7083 - protein, 9 aa, Homo sapiens
  Light chain CDR3 for antibody 3542 (IGKV1-9)
QQLNSYPFT

SEQ ID NO: 7084 - protein, 10 aa, Homo sapiens
  Heavy chain CDR3 for antibody 3542 (IGHV1-18)
ARSPYYDIDY

SEQ ID NO: 7085 - protein, 7 aa, Homo sapiens
  Light chain CDR3 for antibody 3543 (IGKV3D-7)
QQDYNLP

SEQ ID NO: 7086 - protein, 17 aa, Homo sapiens
  Heavy chain CDR3 for antibody 3543 (IGHV1-8)
ARREWFGSYYYYYGMDV

SEQ ID NO: 7087 - protein, 9 aa, Homo sapiens
  Light chain CDR3 for antibody 3544 (IGKV1-9)
QQLNSHPFT

SEQ ID NO: 7088 - protein, 10 aa, Homo sapiens
  Heavy chain CDR3 for antibody 3544 (IGHV3-33)
ARESSDAMDV

SEQ ID NO: 7089 - protein, 9 aa, Homo sapiens
  Light chain CDR3 for antibody 3545 (IGKV1D-17)
LQHNSYPYT

SEQ ID NO: 7090 - protein, 10 aa, Homo sapiens
  Heavy chain CDR3 for antibody 3545 (IGHV3-33)
ARESADGIDF

SEQ ID NO: 7091 - protein, 9 aa, Homo sapiens
  Light chain CDR3 for antibody 3546 (IGKV1-12)
QQRSNWQYT

SEQ ID NO: 7092 - protein, 10 aa, Homo sapiens
  Heavy chain CDR3 for antibody 3546 (IGHV3-23)
AKESWESFDY

SEQ ID NO: 7093 - protein, 9 aa, Homo sapiens
  Light chain CDR3 for antibody 3547 (IGKV1-9)
QQLISYPYT

SEQ ID NO: 7094 - protein, 15 aa, Homo sapiens
  Heavy chain CDR3 for antibody 3547 (IGHV1-46)
AIEKYYGSGSYPFDS

SEQ ID NO: 7095 - protein, 9 aa, Homo sapiens
  Light chain CDR3 for antibody 3548 (IGKV1-9)
QQLNSYPFT

SEQ ID NO: 7096 - protein, 17 aa, Homo sapiens
  Heavy chain CDR3 for antibody 3548 (IGHV3-30)
VREITMVRVDNYYALDV

SEQ ID NO: 7097 - protein, 9 aa, Homo sapiens
  Light chain CDR3 for antibody 3549 (IGKV1-17)
LQHNSYPYT

SEQ ID NO: 7098 - protein, 13 aa, Homo sapiens
  Heavy chain CDR3 for antibody 3549 (IGHV3-33)
ARGVLWFGELFDY

SEQ ID NO: 7099 - protein, 9 aa, Homo sapiens
  Light chain CDR3 for antibody 3550 (IGKV1-9)
QQFNSYPRT

SEQ ID NO: 7100 - protein, 17 aa, Homo sapiens
  Heavy chain CDR3 for antibody 3550 (IGHV3-13)
ARGRYNSGWYPFNWFDP

SEQ ID NO: 7101 - protein, 9 aa, Homo sapiens
  Light chain CDR3 for antibody 3551 (IGKV1D-17)
LQHNSYPYT

SEQ ID NO: 7102 - protein, 11 aa, Homo sapiens
  Heavy chain CDR3 for antibody 3551 (IGHV3-33)
ARDRRVGATDY

SEQ ID NO: 7103 - protein, 9 aa, Homo sapiens
  Light chain CDR3 for antibody 3552 (IGKV1D-17)
LQHNSYPYT

SEQ ID NO: 7104 - protein, 10 aa, Homo sapiens
  Heavy chain CDR3 for antibody 3552 (IGHV3-33)
TSESTDAMAV

SEQ ID NO: 7105 - protein, 9 aa, Homo sapiens
  Light chain CDR3 for antibody 3553 (IGKV1-9)
QQLNSYPYT

SEQ ID NO: 7106 - protein, 15 aa, Homo sapiens
  Heavy chain CDR3 for antibody 3553 (IGHV1-18)
AREKYDGAGSYPFDS

SEQ ID NO: 7107 - protein, 9 aa, Homo sapiens
  Light chain CDR3 for antibody 3554 (IGKV1-9)
QQLNSYPFT

SEQ ID NO: 7108 - protein, 14 aa, Homo sapiens
  Heavy chain CDR3 for antibody 3554 (IGHV3-23)
AKDRAVAGTYYFDY

SEQ ID NO: 7109 - protein, 9 aa, Homo sapiens
  Light chain CDR3 for antibody 3555 (IGKV1-9)
HQLNSYPYT

SEQ ID NO: 7110 - protein, 15 aa, Homo sapiens
  Heavy chain CDR3 for antibody 3555 (IGHV1-46)
AREKYYGSGSYPFDS

SEQ ID NO: 7111 - protein, 9 aa, Homo sapiens
  Light chain CDR3 for antibody 3556 (IGKV1-9)
QQLNSYPFT

SEQ ID NO: 7112 - protein, 17 aa, Homo sapiens
  Heavy chain CDR3 for antibody 3556 (IGHV3-33)
AREITMVRGDNSSGMEV

SEQ ID NO: 7113 - protein, 9 aa, Homo sapiens
  Light chain CDR3 for antibody 3557 (IGKV1-17)
LQHNSYPWT

SEQ ID NO: 7114 - protein, 13 aa, Homo sapiens
  Heavy chain CDR3 for antibody 3557 (IGHV3-64)
ARETGDSYYGMDV

SEQ ID NO: 7115 - protein, 9 aa, Homo sapiens
  Light chain CDR3 for antibody 3558 (IGKV1D-17)
LQHNSYPYT

SEQ ID NO: 7116 - protein, 10 aa, Homo sapiens
  Heavy chain CDR3 for antibody 3558 (IGHV3-33)
ARETVAGFAS

SEQ ID NO: 7117 - protein, 9 aa, Homo sapiens
  Light chain CDR3 for antibody 3559 (IGKV1D-17)
LQHNSYPYT

SEQ ID NO: 7118 - protein, 10 aa, Homo sapiens
  Heavy chain CDR3 for antibody 3559 (IGHV3-30)
AREYPDGMDV

SEQ ID NO: 7119 - protein, 9 aa, Homo sapiens
  Light chain CDR3 for antibody 3560 (IGKV1-9)
QQLNSHPFT

SEQ ID NO: 7120 - protein, 17 aa, Homo sapiens
  Heavy chain CDR3 for antibody 3560 (IGHV3-30)
AREITMVRGDNYYAIAV

SEQ ID NO: 7121 - protein, 9 aa, Homo sapiens
  Light chain CDR3 for antibody 3561 (IGKV1-9)
QQLNSFPFT

SEQ ID NO: 7122 - protein, 17 aa, Homo sapiens
  Heavy chain CDR3 for antibody 3561 (IGHV3-11)
EREITMDRGDNYYGMDV

SEQ ID NO: 7123 - protein, 9 aa, Homo sapiens
  Light chain CDR3 for antibody 3562 (IGKV1-9)
QQLNSYPYT

SEQ ID NO: 7124 - protein, 15 aa, Homo sapiens
  Heavy chain CDR3 for antibody 3562 (IGHV1-46)
AREKSYVSGRYPFAY

SEQ ID NO: 7125 - protein, 9 aa, Homo sapiens
  Light chain CDR3 for antibody 3563 (IGKV1-9)
QQLNGYPYT

SEQ ID NO: 7126 - protein, 17 aa, Homo sapiens
  Heavy chain CDR3 for antibody 3563 (IGHV3-33)
VREITMVRGDNYYGLDV

SEQ ID NO: 7127 - protein, 9 aa, Homo sapiens
  Light chain CDR3 for antibody 3564 (IGKV6-21)
HQSSSLPYT

SEQ ID NO: 7128 - protein, 15 aa, Homo sapiens
  Heavy chain CDR3 for antibody 3564 (IGHV1-46)
AREKYYGSGSYPFDY

SEQ ID NO: 7129 - protein, 9 aa, Homo sapiens
  Light chain CDR3 for antibody 3565 (IGKV1-27)
QKYNSAPLT

SEQ ID NO: 7130 - protein, 15 aa, Homo sapiens
  Heavy chain CDR3 for antibody 3565 (IGHV1-46)
AREKYYGSGSYPFDY

SEQ ID NO: 7131 - protein, 9 aa, Homo sapiens
  Light chain CDR3 for antibody 3566 (IGKV1D-17)
LQHNSYPYT

SEQ ID NO: 7132 - protein, 10 aa, Homo sapiens
  Heavy chain CDR3 for antibody 3566 (IGHV3-33)
AIESTDGMNA

SEQ ID NO: 7133 - protein, 9 aa, Homo sapiens
  Light chain CDR3 for antibody 3567 (IGKV1-9)
HQLNSYPYT

SEQ ID NO: 7134 - protein, 15 aa, Homo sapiens
  Heavy chain CDR3 for antibody 3567 (IGHV1-46)
AREKYYGSGSYPIEY

SEQ ID NO: 7135 - protein, 9 aa, Homo sapiens
  Light chain CDR3 for antibody 3568 (IGKV1-9)
QQLNSYPFT

SEQ ID NO: 7136 - protein, 27 aa, Homo sapiens
  Heavy chain CDR3 for antibody 3568 (IGHV3-20)
VRDRHIVVVTADSREDSYYYYYYGMDV

SEQ ID NO: 7137 - protein, 9 aa, Homo sapiens
  Light chain CDR3 for antibody 3569 (IGKV1-9)
LQHDSYPYT

SEQ ID NO: 7138 - protein, 10 aa, Homo sapiens
  Heavy chain CDR3 for antibody 3569 (IGHV3-33)
ARESAYGMDV

SEQ ID NO: 7139 - protein, 9 aa, Homo sapiens
  Light chain CDR3 for antibody 3570 (IGKV1-9)
QHLNSHPFT

SEQ ID NO: 7140 - protein, 17 aa, Homo sapiens
  Heavy chain CDR3 for antibody 3570 (IGHV3-33)
AREITMLRGDNYYGLEV

SEQ ID NO: 7141 - protein, 9 aa, Homo sapiens
  Light chain CDR3 for antibody 3571 (IGKV1-9)
QQLNSYPFT

SEQ ID NO: 7142 - protein, 17 aa, Homo sapiens
  Heavy chain CDR3 for antibody 3571 (IGHV3-53)
AREITMVRGANSYGMDA

SEQ ID NO: 7143 - protein, 9 aa, Homo sapiens
  Light chain CDR3 for antibody 3572 (IGKV1-6)
LQDYNYPWT

SEQ ID NO: 7144 - protein, 27 aa, Homo sapiens
  Heavy chain CDR3 for antibody 3572 (IGHV3-20)
ARDRHIVVVTADIREDSYYYYYYGMDV

SEQ ID NO: 7145 - protein, 9 aa, Homo sapiens
  Light chain CDR3 for antibody 3573 (IGKV1-9)
QQLNSYPFT

SEQ ID NO: 7146 - protein, 13 aa, Homo sapiens
  Heavy chain CDR3 for antibody 3573 (IGHV3-33)
ARDWYYGSGSPYY

SEQ ID NO: 7147 - protein, 9 aa, Homo sapiens
  Light chain CDR3 for antibody 3574 (IGKV1-9)
QQLNSYPFT

SEQ ID NO: 7148 - protein, 10 aa, Homo sapiens
  Heavy chain CDR3 for antibody 3574 (IGHV3-33)
ARESTDAIDA

SEQ ID NO: 7149 - protein, 9 aa, Homo sapiens
  Light chain CDR3 for antibody 3575 (IGKV1-9)
QQLNSHPFT

SEQ ID NO: 7150 - protein, 17 aa, Homo sapiens
  Heavy chain CDR3 for antibody 3575 (IGHV3-30)
AREMTMVRGHNYYGMDD

SEQ ID NO: 7151 - protein, 9 aa, Homo sapiens
  Light chain CDR3 for antibody 3576 (IGKV1D-17)
LQHNSYPYT

SEQ ID NO: 7152 - protein, 10 aa, Homo sapiens
  Heavy chain CDR3 for antibody 3576 (IGHV3-33)
AREATDAMDV

SEQ ID NO: 7153 - protein, 9 aa, Homo sapiens
  Light chain CDR3 for antibody 3577 (IGKV1-9)
QQLNSYPFT

SEQ ID NO: 7154 - protein, 17 aa, Homo sapiens
  Heavy chain CDR3 for antibody 3577 (IGHV3-33)
AREITMVRVANSSGMDV

SEQ ID NO: 7155 - protein, 9 aa, Homo sapiens
  Light chain CDR3 for antibody 3578 (IGKV1-9)
QQFNSHPFT

SEQ ID NO: 7156 - protein, 17 aa, Homo sapiens
  Heavy chain CDR3 for antibody 3578 (IGHV3-30)
AREITMVRVYNYYALDV

SEQ ID NO: 7157 - protein, 9 aa, Homo sapiens
  Light chain CDR3 for antibody 3579 (IGKV1-8)
QQYYSYPYT

SEQ ID NO: 7158 - protein, 14 aa, Homo sapiens
  Heavy chain CDR3 for antibody 3579 (IGHV3-23)
AKERAVAGLNGFAP

SEQ ID NO: 7159 - protein, 9 aa, Homo sapiens
  Light chain CDR3 for antibody 3580 (IGKV1D-17)
LQHNSYPWT

SEQ ID NO: 7160 - protein, 9 aa, Homo sapiens
  Heavy chain CDR3 for antibody 3580 (IGHV3-66)
AREGAGIES

SEQ ID NO: 7161 - protein, 9 aa, Homo sapiens
  Light chain CDR3 for antibody 3581 (IGKV1-9)
QQLNSYPFT

SEQ ID NO: 7162 - protein, 17 aa, Homo sapiens
  Heavy chain CDR3 for antibody 3581 (IGHV3-13)
AREMTMGRGDNYDGLDV

SEQ ID NO: 7163 - protein, 9 aa, Homo sapiens
  Light chain CDR3 for antibody 3582 (IGKV1D-17)
LQHNSYPYT

SEQ ID NO: 7164 - protein, 13 aa, Homo sapiens
  Heavy chain CDR3 for antibody 3582 (IGHV3-33)
ARDYCGGDCYPDP

SEQ ID NO: 7165 - protein, 9 aa, Homo sapiens
  Light chain CDR3 for antibody 3583 (IGKV1-9)
QHLNSHPFT

SEQ ID NO: 7166 - protein, 17 aa, Homo sapiens
  Heavy chain CDR3 for antibody 3583 (IGHV3-30)
AREITMVRGDNYYALDA

SEQ ID NO: 7167 - protein, 9 aa, Homo sapiens
  Light chain CDR3 for antibody 3584 (IGKV1-9)
QQLISYPYT

SEQ ID NO: 7168 - protein, 15 aa, Homo sapiens
  Heavy chain CDR3 for antibody 3584 (IGHV1-46)
AREKYYGSGSYPFAS

SEQ ID NO: 7169 - protein, 9 aa, Homo sapiens
  Light chain CDR3 for antibody 3585 (IGKV1-9)
QQLNSYPFT

SEQ ID NO: 7170 - protein, 17 aa, Homo sapiens
  Heavy chain CDR3 for antibody 3585 (IGHV3-33)
ARESNMVRGDNSYGMAV

SEQ ID NO: 7171 - protein, 9 aa, Homo sapiens
  Light chain CDR3 for antibody 3586 (IGKV1-9)
QQLNGYPYT

SEQ ID NO: 7172 - protein, 15 aa, Homo sapiens
  Heavy chain CDR3 for antibody 3586 (IGHV1-46)
ARERCYGSGSYPFDY

SEQ ID NO: 7173 - protein, 9 aa, Homo sapiens
  Light chain CDR3 for antibody 3587 (IGKV1-9)
QQLNSYPFT

SEQ ID NO: 7174 - protein, 17 aa, Homo sapiens
  Heavy chain CDR3 for antibody 3587 (IGHV3-33)
VREITMVRGDNYYGLAV

SEQ ID NO: 7175 - protein, 9 aa, Homo sapiens
  Light chain CDR3 for antibody 3588 (IGKV1D-17)
LQHNSYPYT

SEQ ID NO: 7176 - protein, 10 aa, Homo sapiens
  Heavy chain CDR3 for antibody 3588 (IGHV3-33)
AREATDGMAD

SEQ ID NO: 7177 - protein, 9 aa, Homo sapiens
  Light chain CDR3 for antibody 3589 (IGKV1-9)
QQFNSYPFT

SEQ ID NO: 7178 - protein, 17 aa, Homo sapiens
  Heavy chain CDR3 for antibody 3589 (IGHV3-33)
AREITWVRGDNYYGMDV

SEQ ID NO: 7179 - protein, 9 aa, Homo sapiens
  Light chain CDR3 for antibody 3590 (IGKV1-9)
QQLNSYPFT

SEQ ID NO: 7180 - protein, 17 aa, Homo sapiens
  Heavy chain CDR3 for antibody 3590 (IGHV3-33)
EREITKVRGDNYYGMDF

SEQ ID NO: 7181 - protein, 9 aa, Homo sapiens
  Light chain CDR3 for antibody 3591 (IGKV1-9)
QQLNSYPYT

SEQ ID NO: 7182 - protein, 15 aa, Homo sapiens
  Heavy chain CDR3 for antibody 3591 (IGHV1-46)
VRKKYYGSGTYPFDY

SEQ ID NO: 7183 - protein, 9 aa, Homo sapiens
  Light chain CDR3 for antibody 3592 (IGKV1-9)
QQLNSHPFT

SEQ ID NO: 7184 - protein, 17 aa, Homo sapiens
  Heavy chain CDR3 for antibody 3592 (IGHV3-33)
AREITKVRGDNCYGMDD

SEQ ID NO: 7185 - protein, 9 aa, Homo sapiens
  Light chain CDR3 for antibody 3593 (IGKV1-9)
QQLNSYPFT

SEQ ID NO: 7186 - protein, 17 aa, Homo sapiens
  Heavy chain CDR3 for antibody 3593 (IGHV3-33)
ARESTMVRGDNYYGMDA

SEQ ID NO: 7187 - protein, 9 aa, Homo sapiens
  Light chain CDR3 for antibody 3594 (IGKV3-15)
QQYNNWPRT

SEQ ID NO: 7188 - protein, 16 aa, Homo sapiens
  Heavy chain CDR3 for antibody 3594 (IGHV3-66)
ARDRDMVGTGEYCFDY

SEQ ID NO: 7189 - protein, 9 aa, Homo sapiens
  Light chain CDR3 for antibody 3595 (IGKV1-9)
QQLNSYPFT

SEQ ID NO: 7190 - protein, 17 aa, Homo sapiens
  Heavy chain CDR3 for antibody 3595 (IGHV3-33)
ARESTMIRGDNSYGMDV

SEQ ID NO: 7191 - protein, 9 aa, Homo sapiens
  Light chain CDR3 for antibody 3596 (IGKV1D-17)
LQHNSYPYT

SEQ ID NO: 7192 - protein, 10 aa, Homo sapiens
  Heavy chain CDR3 for antibody 3596 (IGHV3-33)
SRESFSGFDY

SEQ ID NO: 7193 - protein, 9 aa, Homo sapiens
  Light chain CDR3 for antibody 3597 (IGKV1-9)
QQLNSYPFT

SEQ ID NO: 7194 - protein, 17 aa, Homo sapiens
  Heavy chain CDR3 for antibody 3597 (IGHV3-30)
EREITMVRGANYYAMDV

SEQ ID NO: 7195 - protein, 9 aa, Homo sapiens
  Light chain CDR3 for antibody 3598 (IGKV1-27)
QKYNSAPYT

SEQ ID NO: 7196 - protein, 17 aa, Homo sapiens
  Heavy chain CDR3 for antibody 3598 (IGHV3-33)
AREITMVRGDNYYGLDV

SEQ ID NO: 7197 - protein, 9 aa, Homo sapiens
  Light chain CDR3 for antibody 3599 (IGKV1-9)
QHLNSHPFT

SEQ ID NO: 7198 - protein, 17 aa, Homo sapiens
  Heavy chain CDR3 for antibody 3599 (IGHV3-7)
AGEITMVRGDNYYGLDV

SEQ ID NO: 7199 - protein, 9 aa, Homo sapiens
  Light chain CDR3 for antibody 3600 (IGKV1-9)
QQLNSYPFT

SEQ ID NO: 7200 - protein, 17 aa, Homo sapiens
  Heavy chain CDR3 for antibody 3600 (IGHV3-33)
ARAITMGRGDNYYGMDV

SEQ ID NO: 7201 - protein, 9 aa, Homo sapiens
  Light chain CDR3 for antibody 3601 (IGKV1-9)
QHLNSHPFT

SEQ ID NO: 7202 - protein, 17 aa, Homo sapiens
  Heavy chain CDR3 for antibody 3601 (IGHV3-23)
EREITRVRGYNYYGMDV

SEQ ID NO: 7203 - protein, 9 aa, Homo sapiens
  Light chain CDR3 for antibody 3602 (IGKV1-9)
QQLNSYPYT

SEQ ID NO: 7204 - protein, 15 aa, Homo sapiens
  Heavy chain CDR3 for antibody 3602 (IGHV1-46)
TREKYYGSGTYPFAY

SEQ ID NO: 7205 - protein, 9 aa, Homo sapiens
  Light chain CDR3 for antibody 3603 (IGKV1-9)
QQLNSHPFT

SEQ ID NO: 7206 - protein, 17 aa, Homo sapiens
  Heavy chain CDR3 for antibody 3603 (IGHV3-33)
AREITMERGYNYYGMDV

SEQ ID NO: 7207 - protein, 9 aa, Homo sapiens
  Light chain CDR3 for antibody 3604 (IGKV1-9)
QQLISYPYT

SEQ ID NO: 7208 - protein, 15 aa, Homo sapiens
  Heavy chain CDR3 for antibody 3604 (IGHV1-46)
ARQKYYGSASYPFDY

SEQ ID NO: 7209 - protein, 9 aa, Homo sapiens
  Light chain CDR3 for antibody 3605 (IGKV1-9)
HQLNSYPYT

SEQ ID NO: 7210 - protein, 15 aa, Homo sapiens
  Heavy chain CDR3 for antibody 3605 (IGHV1-46)
AREKYQGSGSYPFDD

SEQ ID NO: 7211 - protein, 9 aa, Homo sapiens
  Light chain CDR3 for antibody 3606 (IGKV1D-17)
LQHNSYPYT

SEQ ID NO: 7212 - protein, 19 aa, Homo sapiens
  Heavy chain CDR3 for antibody 3606 (IGHV1-18)
ARDHGYCSSTSCYRAWFDP

SEQ ID NO: 7213 - protein, 9 aa, Homo sapiens
  Light chain CDR3 for antibody 3607 (IGKV1D-17)
LQHNSYPYT

SEQ ID NO: 7214 - protein, 10 aa, Homo sapiens
  Heavy chain CDR3 for antibody 3607 (IGHV3-33)
AREATDAMDD

SEQ ID NO: 7215 - protein, 9 aa, Homo sapiens
  Light chain CDR3 for antibody 3608 (IGKV3-15)
QQYNNWPLT

SEQ ID NO: 7216 - protein, 14 aa, Homo sapiens
  Heavy chain CDR3 for antibody 3608 (IGHV3-23)
AKEIAVAGHWYFDL

SEQ ID NO: 7217 - protein, 9 aa, Homo sapiens
  Light chain CDR3 for antibody 3609 (IGKV1-9)
HQLNSYPYT

SEQ ID NO: 7218 - protein, 15 aa, Homo sapiens
  Heavy chain CDR3 for antibody 3609 (IGHV1-46)
AREKYHGSGSDPFDY

SEQ ID NO: 7219 - protein, 9 aa, Homo sapiens
  Light chain CDR3 for antibody 3610 (IGKV1-9)
QQLNSYPFT

SEQ ID NO: 7220 - protein, 17 aa, Homo sapiens
  Heavy chain CDR3 for antibody 3610 (IGHV3-33)
EREITLVRGDNYYSMDV

SEQ ID NO: 7221 - protein, 9 aa, Homo sapiens
  Light chain CDR3 for antibody 3611 (IGKV1-8)
QQYYSYPYT

SEQ ID NO: 7222 - protein, 10 aa, Homo sapiens
  Heavy chain CDR3 for antibody 3611 (IGHV3-33)
ARETVAGFDY

SEQ ID NO: 7223 - protein, 9 aa, Homo sapiens
  Light chain CDR3 for antibody 3612 (IGKV1-9)
QHLNSHPFT

SEQ ID NO: 7224 - protein, 17 aa, Homo sapiens
  Heavy chain CDR3 for antibody 3612 (IGHV3-33)
AREINMGRGDNYYGMDG

SEQ ID NO: 7225 - protein, 9 aa, Homo sapiens
  Light chain CDR3 for antibody 3613 (IGKV1-9)
QQLNSHPFT

SEQ ID NO: 7226 - protein, 17 aa, Homo sapiens
  Heavy chain CDR3 for antibody 3613 (IGHV3-30)
AREMTMGRGDNSYGMDV

SEQ ID NO: 7227 - protein, 9 aa, Homo sapiens
  Light chain CDR3 for antibody 3614 (IGKV1D-17)
LQHNSYPYT

SEQ ID NO: 7228 - protein, 17 aa, Homo sapiens
  Heavy chain CDR3 for antibody 3614 (IGHV3-33)
AREIAMVRGDDCYGMDD

SEQ ID NO: 7229 - protein, 9 aa, Homo sapiens
  Light chain CDR3 for antibody 3615 (IGKV1-9)
QQLISYPFT

SEQ ID NO: 7230 - protein, 17 aa, Homo sapiens
  Heavy chain CDR3 for antibody 3615 (IGHV3-33)
AREITLVRGDTYYGMYV

SEQ ID NO: 7231 - protein, 9 aa, Homo sapiens
  Light chain CDR3 for antibody 3616 (IGKV1-9)
QQLNSYPFT

SEQ ID NO: 7232 - protein, 18 aa, Homo sapiens
  Heavy chain CDR3 for antibody 3616 (IGHV3-11)
ARYGDPERDYYYYYGMDV

SEQ ID NO: 7233 - protein, 9 aa, Homo sapiens
  Light chain CDR3 for antibody 3617 (IGKV1D-17)
LQHNSYPYT

SEQ ID NO: 7234 - protein, 10 aa, Homo sapiens
  Heavy chain CDR3 for antibody 3617 (IGHV3-33)
TSESSYGMDV

SEQ ID NO: 7235 - protein, 9 aa, Homo sapiens
  Light chain CDR3 for antibody 3618 (IGKV1D-17)
LQHNSYPYT

SEQ ID NO: 7236 - protein, 10 aa, Homo sapiens
  Heavy chain CDR3 for antibody 3618 (IGHV3-33)
AIESTYGMYV

SEQ ID NO: 7237 - protein, 9 aa, Homo sapiens
  Light chain CDR3 for antibody 3619 (IGKV1-6)
LQDYDYPWT

SEQ ID NO: 7238 - protein, 18 aa, Homo sapiens
  Heavy chain CDR3 for antibody 3619 (IGHV3-11)
ARYGDPERDDYYYYGMEV

SEQ ID NO: 7239 - protein, 9 aa, Homo sapiens
  Light chain CDR3 for antibody 3620 (IGKV1-9)
QQLNSYPFT

SEQ ID NO: 7240 - protein, 17 aa, Homo sapiens
  Heavy chain CDR3 for antibody 3620 (IGHV3-30)
EREITMGRGENYYGMDV

SEQ ID NO: 7241 - protein, 9 aa, Homo sapiens
  Light chain CDR3 for antibody 3621 (IGKV1-9)
QQLNSHPFT

SEQ ID NO: 7242 - protein, 17 aa, Homo sapiens
  Heavy chain CDR3 for antibody 3621 (IGHV3-30)
EREITMARGDNYYGMDD

SEQ ID NO: 7243 - protein, 9 aa, Homo sapiens
  Light chain CDR3 for antibody 3622 (IGKV1-9)
QQFNSYPFT

SEQ ID NO: 7244 - protein, 17 aa, Homo sapiens
  Heavy chain CDR3 for antibody 3622 (IGHV3-64)
WREITMFRGDNYYGIDV

SEQ ID NO: 7245 - protein, 9 aa, Homo sapiens
  Light chain CDR3 for antibody 3623 (IGKV1-9)
QQLISYPYT

SEQ ID NO: 7246 - protein, 15 aa, Homo sapiens
  Heavy chain CDR3 for antibody 3623 (IGHV1-46)
AREKYYVSESYPFDS

SEQ ID NO: 7247 - protein, 9 aa, Homo sapiens
  Light chain CDR3 for antibody 3624 (IGKV1-9)
QQLNSYPFT

SEQ ID NO: 7248 - protein, 17 aa, Homo sapiens
  Heavy chain CDR3 for antibody 3624 (IGHV3-33)
AREINMFRGDTYYGMDV

SEQ ID NO: 7249 - protein, 9 aa, Homo sapiens
  Light chain CDR3 for antibody 3625 (IGKV1-9)
QQFNSYPFT

SEQ ID NO: 7250 - protein, 17 aa, Homo sapiens
  Heavy chain CDR3 for antibody 3625 (IGHV3-33)
ARESTLVRGDTYYGMDV

SEQ ID NO: 7251 - protein, 9 aa, Homo sapiens
  Light chain CDR3 for antibody 3626 (IGKV1-9)
QQLNSHPFT

SEQ ID NO: 7252 - protein, 17 aa, Homo sapiens
  Heavy chain CDR3 for antibody 3626 (IGHV3-33)
AREIPMGRGDNSYGLDV

SEQ ID NO: 7253 - protein, 9 aa, Homo sapiens
  Light chain CDR3 for antibody 3627 (IGKV1-9)
HQLISYPYT

SEQ ID NO: 7254 - protein, 10 aa, Homo sapiens
  Heavy chain CDR3 for antibody 3627 (IGHV3-33)
AREGRTGFEY

SEQ ID NO: 7255 - protein, 9 aa, Homo sapiens
  Light chain CDR3 for antibody 3628 (IGKV1D-17)
LQHNSYPYT

SEQ ID NO: 7256 - protein, 10 aa, Homo sapiens
  Heavy chain CDR3 for antibody 3628 (IGHV3-33)
ASASTDGIDA

SEQ ID NO: 7257 - protein, 9 aa, Homo sapiens
  Light chain CDR3 for antibody 3629 (IGKV1-9)
QQFNSYPFT

SEQ ID NO: 7258 - protein, 17 aa, Homo sapiens
  Heavy chain CDR3 for antibody 3629 (IGHV3-33)
EREIPRVRGENYYGLDV

SEQ ID NO: 7259 - protein, 9 aa, Homo sapiens
  Light chain CDR3 for antibody 3630 (IGKV1-9)
QQLNSYPYT

SEQ ID NO: 7260 - protein, 15 aa, Homo sapiens
  Heavy chain CDR3 for antibody 3630 (IGHV1-46)
AIEKYYVSGSYPFNY

SEQ ID NO: 7261 - protein, 9 aa, Homo sapiens
  Light chain CDR3 for antibody 3631 (IGKV1D-17)
LQHNSYPYT

SEQ ID NO: 7262 - protein, 10 aa, Homo sapiens
  Heavy chain CDR3 for antibody 3631 (IGHV3-33)
ASDPTDGMDV

SEQ ID NO: 7263 - protein, 9 aa, Homo sapiens
  Light chain CDR3 for antibody 3632 (IGKV1D-17)
QQLNSYPFT

SEQ ID NO: 7264 - protein, 17 aa, Homo sapiens
  Heavy chain CDR3 for antibody 3632 (IGHV3-33)
AREITMVRGDTSYAMDV

SEQ ID NO: 7265 - protein, 9 aa, Homo sapiens
  Light chain CDR3 for antibody 3633 (IGKV1-9)
QQLNSYPYT

SEQ ID NO: 7266 - protein, 15 aa, Homo sapiens
  Heavy chain CDR3 for antibody 3633 (IGHV1-46)
AGEKYYGSGSYPFAY

SEQ ID NO: 7267 - protein, 9 aa, Homo sapiens
  Light chain CDR3 for antibody 3634 (IGKV1D-17)
LQHNSYPYT

SEQ ID NO: 7268 - protein, 13 aa, Homo sapiens
  Heavy chain CDR3 for antibody 3634 (IGHV3-23)
AKGPITISLYFDY

SEQ ID NO: 7269 - protein, 9 aa, Homo sapiens
  Light chain CDR3 for antibody 3635 (IGKV1-9)
QQLNSYPFT

SEQ ID NO: 7270 - protein, 17 aa, Homo sapiens
  Heavy chain CDR3 for antibody 3635 (IGHV3-33)
AREITMGRGDNDYGMDV

SEQ ID NO: 7271 - protein, 9 aa, Homo sapiens
  Light chain CDR3 for antibody 3636 (IGKV1-9)
QQLNGYPYT

SEQ ID NO: 7272 - protein, 17 aa, Homo sapiens
  Heavy chain CDR3 for antibody 3636 (IGHV1-46)
AREITMVRGDDYYGMDV

SEQ ID NO: 7273 - protein, 9 aa, Homo sapiens
  Light chain CDR3 for antibody 3637 (IGKV1-9)
QQLNSYPFT

SEQ ID NO: 7274 - protein, 17 aa, Homo sapiens
  Heavy chain CDR3 for antibody 3637 (IGHV3-33)
ARESTMVRGDDCYGLDV

SEQ ID NO: 7275 - protein, 9 aa, Homo sapiens
  Light chain CDR3 for antibody 3638 (IGKV1-9)
HQLNSYPYT

SEQ ID NO: 7276 - protein, 15 aa, Homo sapiens
  Heavy chain CDR3 for antibody 3638 (IGHV1-46)
AREKYQGSGSYPIAY

SEQ ID NO: 7277 - protein, 9 aa, Homo sapiens
  Light chain CDR3 for antibody 3639 (IGKV1D-17)
LQHNSYPYT

SEQ ID NO: 7278 - protein, 10 aa, Homo sapiens
  Heavy chain CDR3 for antibody 3639 (IGHV3-33)
SRASTDGIDV

SEQ ID NO: 7279 - protein, 9 aa, Homo sapiens
  Light chain CDR3 for antibody 3640 (IGKV1-9)
QQLNGYPYT

SEQ ID NO: 7280 - protein, 15 aa, Homo sapiens
  Heavy chain CDR3 for antibody 3640 (IGHV1-46)
AIYKYYGSASYPFDY

SEQ ID NO: 7281 - protein, 9 aa, Homo sapiens
  Light chain CDR3 for antibody 3641 (IGKV1-9)
QQFNSHPFT

SEQ ID NO: 7282 - protein, 10 aa, Homo sapiens
  Heavy chain CDR3 for antibody 3641 (IGHV3-33)
ARESSDGIDA

SEQ ID NO: 7283 - protein, 9 aa, Homo sapiens
  Light chain CDR3 for antibody 3642 (IGKV1D-17)
LQHDSYPYT

SEQ ID NO: 7284 - protein, 10 aa, Homo sapiens
  Heavy chain CDR3 for antibody 3642 (IGHV3-33)
AIDSTDGMAV

SEQ ID NO: 7285 - protein, 9 aa, Homo sapiens
  Light chain CDR3 for antibody 3643 (IGKV1-9)
QQFNSHPFT

SEQ ID NO: 7286 - protein, 17 aa, Homo sapiens
  Heavy chain CDR3 for antibody 3643 (IGHV3-33)
EREMTMVRGDNYYGMDV

SEQ ID NO: 7287 - protein, 9 aa, Homo sapiens
  Light chain CDR3 for antibody 3644 (IGKV1-9)
QQFNSHPFT

SEQ ID NO: 7288 - protein, 17 aa, Homo sapiens
  Heavy chain CDR3 for antibody 3644 (IGHV3-33)
AREINMVRGDDYYGLDV

SEQ ID NO: 7289 - protein, 9 aa, Homo sapiens
  Light chain CDR3 for antibody 3645 (IGKV1-9)
QQFNSYPFT

SEQ ID NO: 7290 - protein, 17 aa, Homo sapiens
  Heavy chain CDR3 for antibody 3645 (IGHV3-33)
AREITLVRGANYYGMDV

SEQ ID NO: 7291 - protein, 9 aa, Homo sapiens
  Light chain CDR3 for antibody 3646 (IGKV1-9)
QQLNSYPFT

SEQ ID NO: 7292 - protein, 13 aa, Homo sapiens
  Heavy chain CDR3 for antibody 3646 (IGHV3-23)
AKGPITISLYFDY

SEQ ID NO: 7293 - protein, 9 aa, Homo sapiens
  Light chain CDR3 for antibody 3647 (IGKV1-9)
QQLNSHPFT

SEQ ID NO: 7294 - protein, 17 aa, Homo sapiens
  Heavy chain CDR3 for antibody 3647 (IGHV3-74)
EREGTMDRGDSYYGLDV

SEQ ID NO: 7295 - protein, 9 aa, Homo sapiens
  Light chain CDR3 for antibody 3648 (IGKV1D-17)
LQHNSYPYT

SEQ ID NO: 7296 - protein, 10 aa, Homo sapiens
  Heavy chain CDR3 for antibody 3648 (IGHV3-33)
AIYSTAGMDA

SEQ ID NO: 7297 - protein, 9 aa, Homo sapiens
  Light chain CDR3 for antibody 3649 (IGKV1-9)
QQLNSYPFT

SEQ ID NO: 7298 - protein, 17 aa, Homo sapiens
  Heavy chain CDR3 for antibody 3649 (IGHV3-33)
AREITMFRGANSYCMDV

SEQ ID NO: 7299 - protein, 9 aa, Homo sapiens
  Light chain CDR3 for antibody 3650 (IGKV1D-17)
LQHNSYPYT

SEQ ID NO: 7300 - protein, 10 aa, Homo sapiens
  Heavy chain CDR3 for antibody 3650 (IGHV3-33)
AIESPAGIDV

SEQ ID NO: 7301 - protein, 9 aa, Homo sapiens
  Light chain CDR3 for antibody 3651 (IGKV1D-17)
LQHNSYPFT

SEQ ID NO: 7302 - protein, 17 aa, Homo sapiens
  Heavy chain CDR3 for antibody 3651 (IGHV3-33)
AREITMVRGDTYYGLDV

SEQ ID NO: 7303 - protein, 9 aa, Homo sapiens
  Light chain CDR3 for antibody 3652 (IGKV1D-17)
LQHNSYPYT

SEQ ID NO: 7304 - protein, 10 aa, Homo sapiens
  Heavy chain CDR3 for antibody 3652 (IGHV3-33)
ASESTYGMEV

SEQ ID NO: 7305 - protein, 9 aa, Homo sapiens
  Light chain CDR3 for antibody 3653 (IGKV1-9)
QQLNSYPFT

SEQ ID NO: 7306 - protein, 17 aa, Homo sapiens
  Heavy chain CDR3 for antibody 3653 (IGHV3-33)
AREINMARGDNYYGMEV

SEQ ID NO: 7307 - protein, 9 aa, Homo sapiens
  Light chain CDR3 for antibody 3654 (IGKV1-9)
QQLNSYPFT

SEQ ID NO: 7308 - protein, 17 aa, Homo sapiens
  Heavy chain CDR3 for antibody 3654 (IGHV3-33)
AREITMGRGDNYHGIDV

SEQ ID NO: 7309 - protein, 9 aa, Homo sapiens
  Light chain CDR3 for antibody 3655 (IGKV1-9)
QQLNSYPFT

SEQ ID NO: 7310 - protein, 15 aa, Homo sapiens
  Heavy chain CDR3 for antibody 3655 (IGHV1-46)
AREKYYGAGSYPFDA

SEQ ID NO: 7311 - protein, 9 aa, Homo sapiens
  Light chain CDR3 for antibody 3656 (IGKV1-9)
HQLISYPYT

SEQ ID NO: 7312 - protein, 15 aa, Homo sapiens
  Heavy chain CDR3 for antibody 3656 (IGHV1-46)
AREKYYGSASYPFAY

SEQ ID NO: 7313 - protein, 9 aa, Homo sapiens
  Light chain CDR3 for antibody 3657 (IGKV1D-17)
LQHNSYPYT

SEQ ID NO: 7314 - protein, 10 aa, Homo sapiens
  Heavy chain CDR3 for antibody 3657 (IGHV3-33)
ARETVSWFDY

SEQ ID NO: 7315 - protein, 9 aa, Homo sapiens
  Light chain CDR3 for antibody 3658 (IGKV1D-17)
LQHNSYPYT

SEQ ID NO: 7316 - protein, 10 aa, Homo sapiens
  Heavy chain CDR3 for antibody 3658 (IGHV3-66)
ARESGEGLDS

SEQ ID NO: 7317 - protein, 9 aa, Homo sapiens
  Light chain CDR3 for antibody 3659 (IGKV1-9)
HQLNSYPYT

SEQ ID NO: 7318 - protein, 15 aa, Homo sapiens
  Heavy chain CDR3 for antibody 3659 (IGHV1-46)
AREKYQGSGSYPFEY

SEQ ID NO: 7319 - protein, 9 aa, Homo sapiens
  Light chain CDR3 for antibody 3660 (IGKV1D-17)
LQHNSYPYT

SEQ ID NO: 7320 - protein, 10 aa, Homo sapiens
  Heavy chain CDR3 for antibody 3660 (IGHV3-33)
ARESTDGIDF

SEQ ID NO: 7321 - protein, 9 aa, Homo sapiens
  Light chain CDR3 for antibody 3661 (IGKV1-9)
QQFNSHPFT

SEQ ID NO: 7322 - protein, 17 aa, Homo sapiens
  Heavy chain CDR3 for antibody 3661 (IGHV3-30)
AREITRVRGDNSYALDV

SEQ ID NO: 7323 - protein, 9 aa, Homo sapiens
  Light chain CDR3 for antibody 3662 (IGKV1-9)
QQLNSYPLT

SEQ ID NO: 7324 - protein, 15 aa, Homo sapiens
  Heavy chain CDR3 for antibody 3662 (IGHV1-46)
AREGLAGYYPNWFDH

SEQ ID NO: 7325 - protein, 9 aa, Homo sapiens
  Light chain CDR3 for antibody 3663 (IGKV1-9)
QQLNSYPYT

SEQ ID NO: 7326 - protein, 15 aa, Homo sapiens
  Heavy chain CDR3 for antibody 3663 (IGHV1-46)
GIEKYYGAGSYPFDY

SEQ ID NO: 7327 - protein, 9 aa, Homo sapiens
  Light chain CDR3 for antibody 3664 (IGKV1-9)
QQLNGYPYT

SEQ ID NO: 7328 - protein, 15 aa, Homo sapiens
  Heavy chain CDR3 for antibody 3664 (IGHV1-46)
AREKYYGSGSYPLAY

SEQ ID NO: 7329 - protein, 9 aa, Homo sapiens
  Light chain CDR3 for antibody 3665 (IGKV1D-17)
LQHNSYPYT

SEQ ID NO: 7330 - protein, 10 aa, Homo sapiens
  Heavy chain CDR3 for antibody 3665 (IGHV3-33)
AREAAAGMDF

SEQ ID NO: 7331 - protein, 9 aa, Homo sapiens
  Light chain CDR3 for antibody 3666 (IGKV1-9)
QQFNSYPFT

SEQ ID NO: 7332 - protein, 17 aa, Homo sapiens
  Heavy chain CDR3 for antibody 3666 (IGHV3-33)
GRESTMVRGENYYGMDV

SEQ ID NO: 7333 - protein, 9 aa, Homo sapiens
  Light chain CDR3 for antibody 3667 (IGKV1-9)
QQLNSYPFT

SEQ ID NO: 7334 - protein, 17 aa, Homo sapiens
  Heavy chain CDR3 for antibody 3667 (IGHV3-33)
AREISMGRGDNYYGLDV

SEQ ID NO: 7335 - protein, 9 aa, Homo sapiens
  Light chain CDR3 for antibody 3668 (IGKV1-9)
QQLNSYPFT

SEQ ID NO: 7336 - protein, 10 aa, Homo sapiens
  Heavy chain CDR3 for antibody 3668 (IGHV3-33)
ARDSSYGMDV

SEQ ID NO: 7337 - protein, 9 aa, Homo sapiens
  Light chain CDR3 for antibody 3669 (IGKV1D-17)
LQHNSYPYT

SEQ ID NO: 7338 - protein, 10 aa, Homo sapiens
  Heavy chain CDR3 for antibody 3669 (IGHV3-33)
ASDSTDGMDL

SEQ ID NO: 7339 - protein, 9 aa, Homo sapiens
  Light chain CDR3 for antibody 3670 (IGKV1D-17)
LQHNSYPYT

SEQ ID NO: 7340 - protein, 17 aa, Homo sapiens
  Heavy chain CDR3 for antibody 3670 (IGHV3-33)
AREITMVRGDNSYAMDA

SEQ ID NO: 7341 - protein, 9 aa, Homo sapiens
  Light chain CDR3 for antibody 3671 (IGKV1D-17)
LQHNSYPYT

SEQ ID NO: 7342 - protein, 10 aa, Homo sapiens
  Heavy chain CDR3 for antibody 3671 (IGHV3-33)
AREAPAGMEA

SEQ ID NO: 7343 - protein, 9 aa, Homo sapiens
  Light chain CDR3 for antibody 3672 (IGKV1D-17)
LQHNSYPYT

SEQ ID NO: 7344 - protein, 10 aa, Homo sapiens
  Heavy chain CDR3 for antibody 3672 (IGHV3-33)
TRESGECFDY

SEQ ID NO: 7345 - protein, 9 aa, Homo sapiens
  Light chain CDR3 for antibody 3673 (IGKV1-9)
HQLISYPYT

SEQ ID NO: 7346 - protein, 15 aa, Homo sapiens
  Heavy chain CDR3 for antibody 3673 (IGHV1-46)
AREKYYGSESYPIDY

SEQ ID NO: 7347 - protein, 9 aa, Homo sapiens
  Light chain CDR3 for antibody 3674 (IGKV1D-17)
LQHNSYPYT

SEQ ID NO: 7348 - protein, 10 aa, Homo sapiens
  Heavy chain CDR3 for antibody 3674 (IGHV3-30)
TRESTDGINS

SEQ ID NO: 7349 - protein, 9 aa, Homo sapiens
  Light chain CDR3 for antibody 3675 (IGKV1-9)
QQLNSYPYT

SEQ ID NO: 7350 - protein, 15 aa, Homo sapiens
  Heavy chain CDR3 for antibody 3675 (IGHV1-46)
VREKYYGSGSYALDY

SEQ ID NO: 7351 - protein, 9 aa, Homo sapiens
  Light chain CDR3 for antibody 3676 (IGKV1-9)
QQLNSYPYT

SEQ ID NO: 7352 - protein, 15 aa, Homo sapiens
  Heavy chain CDR3 for antibody 3676 (IGHV1-46)
AREKYYGSGSSPFEY

SEQ ID NO: 7353 - protein, 9 aa, Homo sapiens
  Light chain CDR3 for antibody 3677 (IGKV1-9)
QQLNGYPYT

SEQ ID NO: 7354 - protein, 15 aa, Homo sapiens
  Heavy chain CDR3 for antibody 3677 (IGHV1-46)
AREKYYGAKSYPFDC

SEQ ID NO: 7355 - protein, 9 aa, Homo sapiens
  Light chain CDR3 for antibody 3678 (IGKV1-9)
QQLNSHPFT

SEQ ID NO: 7356 - protein, 17 aa, Homo sapiens
  Heavy chain CDR3 for antibody 3678 (IGHV3-33)
EREVTIVRGENYYGLDV

SEQ ID NO: 7357 - protein, 9 aa, Homo sapiens
  Light chain CDR3 for antibody 3679 (IGKV1-9)
QHLNSHPFT

SEQ ID NO: 7358 - protein, 17 aa, Homo sapiens
  Heavy chain CDR3 for antibody 3679 (IGHV3-33)
AREIARVRGDSYYGMDV

SEQ ID NO: 7359 - protein, 9 aa, Homo sapiens
  Light chain CDR3 for antibody 3680 (IGKV1D-17)
LQHNSYPYT

SEQ ID NO: 7360 - protein, 10 aa, Homo sapiens
  Heavy chain CDR3 for antibody 3680 (IGHV3-33)
ARASTDGIEA

SEQ ID NO: 7361 - protein, 9 aa, Homo sapiens
  Light chain CDR3 for antibody 3681 (IGKV1-9)
QQLNSYPFT

SEQ ID NO: 7362 - protein, 17 aa, Homo sapiens
  Heavy chain CDR3 for antibody 3681 (IGHV3-33)
AREITVVRGDNYSGMDA

SEQ ID NO: 7363 - protein, 9 aa, Homo sapiens
  Light chain CDR3 for antibody 3682 (IGKV1-9)
QQLNSYPFT

SEQ ID NO: 7364 - protein, 17 aa, Homo sapiens
  Heavy chain CDR3 for antibody 3682 (IGHV3-33)
EREITVGRGDNYYGMDV

SEQ ID NO: 7365 - protein, 9 aa, Homo sapiens
  Light chain CDR3 for antibody 3683 (IGKV1-9)
QQLNSYPFT

SEQ ID NO: 7366 - protein, 17 aa, Homo sapiens
  Heavy chain CDR3 for antibody 3683 (IGHV3-38)
AREITMIPGDNYYAMDV

SEQ ID NO: 7367 - protein, 9 aa, Homo sapiens
  Light chain CDR3 for antibody 3684 (IGKV1-9)
QQLNSYPFT

SEQ ID NO: 7368 - protein, 17 aa, Homo sapiens
  Heavy chain CDR3 for antibody 3684 (IGHV3-33)
AREITMVRGDNYSGIDV

SEQ ID NO: 7369 - protein, 9 aa, Homo sapiens
  Light chain CDR3 for antibody 3685 (IGKV1-8)
QQYCSYPFT

SEQ ID NO: 7370 - protein, 18 aa, Homo sapiens
  Heavy chain CDR3 for antibody 3685 (IGHV3-11)
ARDRGIAAAGTYYYGMAV

SEQ ID NO: 7371 - protein, 9 aa, Homo sapiens
  Light chain CDR3 for antibody 3686 (IGKV1-9)
QQLNSHPFT

SEQ ID NO: 7372 - protein, 17 aa, Homo sapiens
  Heavy chain CDR3 for antibody 3686 (IGHV3-33)
AREVTKVQGYNYYGLDV

SEQ ID NO: 7373 - protein, 9 aa, Homo sapiens
  Light chain CDR3 for antibody 3687 (IGKV1-9)
QQFNSHPFT

SEQ ID NO: 7374 - protein, 17 aa, Homo sapiens
  Heavy chain CDR3 for antibody 3687 (IGHV3-33)
AREITMVRGDNYYGMAG

SEQ ID NO: 7375 - protein, 9 aa, Homo sapiens
  Light chain CDR3 for antibody 3688 (IGKV1-9)
QHLNSHPFT

SEQ ID NO: 7376 - protein, 17 aa, Homo sapiens
  Heavy chain CDR3 for antibody 3688 (IGHV3-33)
ARGITMVRGDNYYGMDV

SEQ ID NO: 7377 - protein, 9 aa, Homo sapiens
  Light chain CDR3 for antibody 3689 (IGKV1D-17)
LQHNSYPYT

SEQ ID NO: 7378 - protein, 10 aa, Homo sapiens
  Heavy chain CDR3 for antibody 3689 (IGHV3-33)
SRASTDAMDA

SEQ ID NO: 7379 - protein, 9 aa, Homo sapiens
  Light chain CDR3 for antibody 3690 (IGKV1-9)
QQLNSHPFT

SEQ ID NO: 7380 - protein, 14 aa, Homo sapiens
  Heavy chain CDR3 for antibody 3690 (IGHV3-33)
AKDRAVAGTYYFDY

SEQ ID NO: 7381 - protein, 9 aa, Homo sapiens
  Light chain CDR3 for antibody 3691 (IGKV1D-17)
LQHNSYPYT

SEQ ID NO: 7382 - protein, 17 aa, Homo sapiens
  Heavy chain CDR3 for antibody 3691 (IGHV3-33)
VREITRVRGDNYYGLAV

SEQ ID NO: 7383 - protein, 9 aa, Homo sapiens
  Light chain CDR3 for antibody 3692 (IGKV1D-17)
LQHNSYPYT

SEQ ID NO: 7384 - protein, 9 aa, Homo sapiens
  Heavy chain CDR3 for antibody 3692 (IGHV3/OR16-1)
GREGAGIDY

SEQ ID NO: 7385 - protein, 9 aa, Homo sapiens
  Light chain CDR3 for antibody 3693 (IGKV1-9)
QQLNSHPFT

SEQ ID NO: 7386 - protein, 17 aa, Homo sapiens
  Heavy chain CDR3 for antibody 3693 (IGHV3-33)
ARESTRVRGDNYDGMDV

SEQ ID NO: 7387 - protein, 9 aa, Homo sapiens
  Light chain CDR3 for antibody 3694 (IGKV1-9)
QQFNSHPFT

SEQ ID NO: 7388 - protein, 17 aa, Homo sapiens
  Heavy chain CDR3 for antibody 3694 (IGHV3-66)
AREITMVRGENSYGMDV

SEQ ID NO: 7389 - protein, 9 aa, Homo sapiens
  Light chain CDR3 for antibody 3695 (IGKV1-9)
QQLISYPYT

SEQ ID NO: 7390 - protein, 10 aa, Homo sapiens
  Heavy chain CDR3 for antibody 3695 (IGHV1-46)
AREYTDGIAV

SEQ ID NO: 7391 - protein, 9 aa, Homo sapiens
  Light chain CDR3 for antibody 3696 (IGKV1D-17)
LQHNSYPYT

SEQ ID NO: 7392 - protein, 10 aa, Homo sapiens
  Heavy chain CDR3 for antibody 3696 (IGHV3-33)
SRESADGMDA

SEQ ID NO: 7393 - protein, 9 aa, Homo sapiens
  Light chain CDR3 for antibody 3697 (IGKV1D-17)
LQHNSYPYT

SEQ ID NO: 7394 - protein, 15 aa, Homo sapiens
  Heavy chain CDR3 for antibody 3697 (IGHV1-46)
AREKYHGSGSYAIDY

SEQ ID NO: 7395 - protein, 9 aa, Homo sapiens
  Light chain CDR3 for antibody 3698 (IGKV1-9)
QQLNSYPFT

SEQ ID NO: 7396 - protein, 17 aa, Homo sapiens
  Heavy chain CDR3 for antibody 3698 (IGHV3-30)
ERAINMVRGEKYYGMDV

SEQ ID NO: 7397 - protein, 9 aa, Homo sapiens
  Light chain CDR3 for antibody 3699 (IGKV1-9)
QHLNSHPFT

SEQ ID NO: 7398 - protein, 17 aa, Homo sapiens
  Heavy chain CDR3 for antibody 3699 (IGHV3-33)
AREITMVRGDNSYGLDA

SEQ ID NO: 7399 - protein, 9 aa, Homo sapiens
  Light chain CDR3 for antibody 3700 (IGKV1-9)
QQLNSYPFT

SEQ ID NO: 7400 - protein, 17 aa, Homo sapiens
  Heavy chain CDR3 for antibody 3700 (IGHV3-33)
ARESALVRGDSYYGMDV

SEQ ID NO: 7401 - protein, 9 aa, Homo sapiens
  Light chain CDR3 for antibody 3701 (IGKV1-9)
QQLNSYPFT

SEQ ID NO: 7402 - protein, 17 aa, Homo sapiens
  Heavy chain CDR3 for antibody 3701 (IGHV3-30)
ARESTIARGDNYYAMDV

SEQ ID NO: 7403 - protein, 9 aa, Homo sapiens
  Light chain CDR3 for antibody 3702 (IGKV1-9)
QHLNSHPFT

SEQ ID NO: 7404 - protein, 17 aa, Homo sapiens
  Heavy chain CDR3 for antibody 3702 (IGHV3-23)
AREITMVRGANYYGMDV

SEQ ID NO: 7405 - protein, 9 aa, Homo sapiens
  Light chain CDR3 for antibody 3703 (IGKV1-9)
QQLISYPYT

SEQ ID NO: 7406 - protein, 15 aa, Homo sapiens
  Heavy chain CDR3 for antibody 3703 (IGHV1-46)
AREKYYGSGSHPFYS

SEQ ID NO: 7407 - protein, 9 aa, Homo sapiens
  Light chain CDR3 for antibody 3704 (IGKV1-9)
QQLNSYPFT

SEQ ID NO: 7408 - protein, 17 aa, Homo sapiens
  Heavy chain CDR3 for antibody 3704 (IGHV3-33)
EREITIVRGDNCYGMDV

SEQ ID NO: 7409 - protein, 9 aa, Homo sapiens
  Light chain CDR3 for antibody 3705 (IGKV1-9)
QQFNSYPFT

SEQ ID NO: 7410 - protein, 17 aa, Homo sapiens
  Heavy chain CDR3 for antibody 3705 (IGHV3-33)
AREITLVRGDNYYGMEA

SEQ ID NO: 7411 - protein, 9 aa, Homo sapiens
  Light chain CDR3 for antibody 3706 (IGKV1-12)
QQANSFPRT

SEQ ID NO: 7412 - protein, 15 aa, Homo sapiens
  Heavy chain CDR3 for antibody 3706 (IGHV3-33)
ARDYSTYYYYYGMDV

SEQ ID NO: 7413 - protein, 9 aa, Homo sapiens
  Light chain CDR3 for antibody 3707 (IGKV1-9)
QQLNSYPFT

SEQ ID NO: 7414 - protein, 17 aa, Homo sapiens
  Heavy chain CDR3 for antibody 3707 (IGHV3-33)
AREVTMVRGDKYDGLDD

SEQ ID NO: 7415 - protein, 9 aa, Homo sapiens
  Light chain CDR3 for antibody 3708 (IGKV1-9)
QQLISYPYT

SEQ ID NO: 7416 - protein, 10 aa, Homo sapiens
  Heavy chain CDR3 for antibody 3708 (IGHV1-46)
ARETVAGFDY

SEQ ID NO: 7417 - protein, 9 aa, Homo sapiens
  Light chain CDR3 for antibody 3709 (IGKV1-9)
QQLNSYPFT

SEQ ID NO: 7418 - protein, 17 aa, Homo sapiens
  Heavy chain CDR3 for antibody 3709 (IGHV3-33)
ARESAMARGDNYYGMDV

SEQ ID NO: 7419 - protein, 9 aa, Homo sapiens
  Light chain CDR3 for antibody 3710 (IGKV3D-20)
QQYGSSPWT

SEQ ID NO: 7420 - protein, 19 aa, Homo sapiens
  Heavy chain CDR3 for antibody 3710 (IGHV1-18)
ASDHGYWSSPSCYRAWFAP

SEQ ID NO: 7421 - protein, 9 aa, Homo sapiens
  Light chain CDR3 for antibody 3711 (IGKV1D-17)
LQHDSYPYT

SEQ ID NO: 7422 - protein, 8 aa, Homo sapiens
  Heavy chain CDR3 for antibody 3711 (IGHV4-59)
ARYEGMDV

SEQ ID NO: 7423 - protein, 9 aa, Homo sapiens
  Light chain CDR3 for antibody 3712 (IGKV1D-17)
LQHNSYPYT

SEQ ID NO: 7424 - protein, 10 aa, Homo sapiens
  Heavy chain CDR3 for antibody 3712 (IGHV3-33)
AREATYGMDS

SEQ ID NO: 7425 - protein, 9 aa, Homo sapiens
  Light chain CDR3 for antibody 3713 (IGKV1-9)
QQLNSYPFT

SEQ ID NO: 7426 - protein, 17 aa, Homo sapiens
  Heavy chain CDR3 for antibody 3713 (IGHV3-33)
AREITVGRGENYYGMDV

SEQ ID NO: 7427 - protein, 9 aa, Homo sapiens
  Light chain CDR3 for antibody 3714 (IGKV1-9)
QQLNSHPFT

SEQ ID NO: 7428 - protein, 17 aa, Homo sapiens
  Heavy chain CDR3 for antibody 3714 (IGHV3-11)
SRAITMVRGSNYYGMDV

SEQ ID NO: 7429 - protein, 9 aa, Homo sapiens
  Light chain CDR3 for antibody 3715 (IGKV1-9)
QQLNSYPFT

SEQ ID NO: 7430 - protein, 17 aa, Homo sapiens
  Heavy chain CDR3 for antibody 3715 (IGHV3-11)
ARAITMGRGENYYGLDV

SEQ ID NO: 7431 - protein, 9 aa, Homo sapiens
  Light chain CDR3 for antibody 3716 (IGKV1-13)
QQLISYPYT

SEQ ID NO: 7432 - protein, 15 aa, Homo sapiens
  Heavy chain CDR3 for antibody 3716 (IGHV1-46)
AREKYYGACSDPFDS

SEQ ID NO: 7433 - protein, 9 aa, Homo sapiens
  Light chain CDR3 for antibody 3717 (IGKV1-9)
QQLNSFPFT

SEQ ID NO: 7434 - protein, 17 aa, Homo sapiens
  Heavy chain CDR3 for antibody 3717 (IGHV3-33)
ARAITMVRGDNSYGMDV

SEQ ID NO: 7435 - protein, 9 aa, Homo sapiens
  Light chain CDR3 for antibody 3718 (IGKV1-9)
QQLNSYPFT

SEQ ID NO: 7436 - protein, 17 aa, Homo sapiens
  Heavy chain CDR3 for antibody 3718 (IGHV3-33)
AREITMDRGDNYYGIDD

SEQ ID NO: 7437 - protein, 9 aa, Homo sapiens
  Light chain CDR3 for antibody 3719 (IGKV1-9)
QQLNSYPFT

SEQ ID NO: 7438 - protein, 17 aa, Homo sapiens
  Heavy chain CDR3 for antibody 3719 (IGHV3-33)
EREITLVRGDNYDGMDD

SEQ ID NO: 7439 - protein, 9 aa, Homo sapiens
  Light chain CDR3 for antibody 3720 (IGKV1-9)
QQLISYPYT

SEQ ID NO: 7440 - protein, 15 aa, Homo sapiens
  Heavy chain CDR3 for antibody 3720 (IGHV1-46)
AREKYYGSGTSPFAS

SEQ ID NO: 7441 - protein, 9 aa, Homo sapiens
  Light chain CDR3 for antibody 3721 (IGKV1-9)
QQLNSYPYT

SEQ ID NO: 7442 - protein, 17 aa, Homo sapiens
  Heavy chain CDR3 for antibody 3721 (IGHV3-33)
AREITMVRGDDYDGMDA

SEQ ID NO: 7443 - protein, 9 aa, Homo sapiens
  Light chain CDR3 for antibody 3722 (IGKV1-9)
QQLNSHPFT

SEQ ID NO: 7444 - protein, 17 aa, Homo sapiens
  Heavy chain CDR3 for antibody 3722 (IGHV3-7)
EREITMVRRYNYYGIDV

SEQ ID NO: 7445 - protein, 9 aa, Homo sapiens
  Light chain CDR3 for antibody 3723 (IGKV1-9)
QQLNSYPFT

SEQ ID NO: 7446 - protein, 10 aa, Homo sapiens
  Heavy chain CDR3 for antibody 3723 (IGHV3-33)
AGESTYGMDA

SEQ ID NO: 7447 - protein, 9 aa, Homo sapiens
  Light chain CDR3 for antibody 3724 (IGKV1-9)
QQFNSHPFT

SEQ ID NO: 7448 - protein, 13 aa, Homo sapiens
  Heavy chain CDR3 for antibody 3724 (IGHV1-24)
ATTYSGYAYYFDY

SEQ ID NO: 7449 - protein, 9 aa, Homo sapiens
  Light chain CDR3 for antibody 3725 (IGKV1-9)
QQLNSYPYT

SEQ ID NO: 7450 - protein, 17 aa, Homo sapiens
  Heavy chain CDR3 for antibody 3725 (IGHV3-30)
ERESTMGRGDNYYGMDV

SEQ ID NO: 7451 - protein, 9 aa, Homo sapiens
  Light chain CDR3 for antibody 3726 (IGKV1-9)
QQLNSYPFT

SEQ ID NO: 7452 - protein, 17 aa, Homo sapiens
  Heavy chain CDR3 for antibody 3726 (IGHV3-33)
AREITLVQGDNYYGIDY

SEQ ID NO: 7453 - protein, 9 aa, Homo sapiens
  Light chain CDR3 for antibody 3727 (IGKV1-9)
QQLNSYPFT

SEQ ID NO: 7454 - protein, 15 aa, Homo sapiens
  Heavy chain CDR3 for antibody 3727 (IGHV1-46)
AREKSYGSGSYAFDS

SEQ ID NO: 7455 - protein, 9 aa, Homo sapiens
  Light chain CDR3 for antibody 3728 (IGKV1-9)
QQLNSYPYT

SEQ ID NO: 7456 - protein, 15 aa, Homo sapiens
  Heavy chain CDR3 for antibody 3728 (IGHV1-46)
AREKYSGSGRSPFDY

SEQ ID NO: 7457 - protein, 9 aa, Homo sapiens
  Light chain CDR3 for antibody 3729 (IGKV1-9)
QQLNSHPFT

SEQ ID NO: 7458 - protein, 10 aa, Homo sapiens
  Heavy chain CDR3 for antibody 3729 (IGHV3-33)
AREATYGMDV

SEQ ID NO: 7459 - protein, 9 aa, Homo sapiens
  Light chain CDR3 for antibody 3730 (IGKV1-9)
QQLNSHPFT

SEQ ID NO: 7460 - protein, 10 aa, Homo sapiens
  Heavy chain CDR3 for antibody 3730 (IGHV3-33)
AIESTDGMAV

SEQ ID NO: 7461 - protein, 9 aa, Homo sapiens
  Light chain CDR3 for antibody 3731 (IGKV1-9)
QQLNSYPFT

SEQ ID NO: 7462 - protein, 17 aa, Homo sapiens
  Heavy chain CDR3 for antibody 3731 (IGHV3-30)
ARESTKVRGANNYGMDV

SEQ ID NO: 7463 - protein, 9 aa, Homo sapiens
  Light chain CDR3 for antibody 3732 (IGKV1D-17)
LQHNSYPYT

SEQ ID NO: 7464 - protein, 10 aa, Homo sapiens
  Heavy chain CDR3 for antibody 3732 (IGHV3-33)
TREATDGMDD

SEQ ID NO: 7465 - protein, 9 aa, Homo sapiens
  Light chain CDR3 for antibody 3733 (IGKV1-9)
QQLNSYPYT

SEQ ID NO: 7466 - protein, 15 aa, Homo sapiens
  Heavy chain CDR3 for antibody 3733 (IGHV1-46)
AREKSYGTGNYPFDD

SEQ ID NO: 7467 - protein, 9 aa, Homo sapiens
  Light chain CDR3 for antibody 3734 (IGKV1-9)
QQLISYPYT

SEQ ID NO: 7468 - protein, 15 aa, Homo sapiens
  Heavy chain CDR3 for antibody 3734 (IGHV1-46)
ARAKYYGSGCYPFAS

SEQ ID NO: 7469 - protein, 9 aa, Homo sapiens
  Light chain CDR3 for antibody 3735 (IGKV1-6)
LQDYNYPWT

SEQ ID NO: 7470 - protein, 10 aa, Homo sapiens
  Heavy chain CDR3 for antibody 3735 (IGHV3-33)
AREAVAGFDY

SEQ ID NO: 7471 - protein, 9 aa, Homo sapiens
  Light chain CDR3 for antibody 3736 (IGKV1-9)
QQLNSYPFT

SEQ ID NO: 7472 - protein, 17 aa, Homo sapiens
  Heavy chain CDR3 for antibody 3736 (IGHV3-33)
AREINMVRGDNYYGIDF

SEQ ID NO: 7473 - protein, 9 aa, Homo sapiens
  Light chain CDR3 for antibody 3737 (IGKV1-9)
QQLNSHPFT

SEQ ID NO: 7474 - protein, 10 aa, Homo sapiens
  Heavy chain CDR3 for antibody 3737 (IGHV3-33)
ARDATDGMDV

SEQ ID NO: 7475 - protein, 9 aa, Homo sapiens
  Light chain CDR3 for antibody 3738 (IGKV1-9)
QQFNSYPFT

SEQ ID NO: 7476 - protein, 17 aa, Homo sapiens
  Heavy chain CDR3 for antibody 3738 (IGHV3-33)
GREIAMVRGDNYYGMDV

SEQ ID NO: 7477 - protein, 9 aa, Homo sapiens
  Light chain CDR3 for antibody 3739 (IGKV1-9)
QQLNGFPYT

SEQ ID NO: 7478 - protein, 15 aa, Homo sapiens
  Heavy chain CDR3 for antibody 3739 (IGHV1-46)
AREKYHGSGSYPFDY

SEQ ID NO: 7479 - protein, 9 aa, Homo sapiens
  Light chain CDR3 for antibody 3740 (IGKV6-21)
HQSSSLPYT

SEQ ID NO: 7480 - protein, 13 aa, Homo sapiens
  Heavy chain CDR3 for antibody 3740 (IGHV1-18)
AREGGSYIVSFDY

SEQ ID NO: 7481 - protein, 9 aa, Homo sapiens
  Light chain CDR3 for antibody 3741 (IGKV1-9)
QQLNSYPLT

SEQ ID NO: 7482 - protein, 15 aa, Homo sapiens
  Heavy chain CDR3 for antibody 3741 (IGHV1-46)
AREGLTGYYPNWFDP

SEQ ID NO: 7483 - protein, 9 aa, Homo sapiens
  Light chain CDR3 for antibody 3742 (IGKV1-9)
QQLNSYPYT

SEQ ID NO: 7484 - protein, 13 aa, Homo sapiens
  Heavy chain CDR3 for antibody 3742 (IGHV3-33)
ARDYCSGDCYPDP

SEQ ID NO: 7485 - protein, 9 aa, Homo sapiens
  Light chain CDR3 for antibody 3743 (IGKV1-9)
QQLNSYPYT

SEQ ID NO: 7486 - protein, 17 aa, Homo sapiens
  Heavy chain CDR3 for antibody 3743 (IGHV3-33)
AREITMLRGDNYYGLDV

SEQ ID NO: 7487 - protein, 9 aa, Homo sapiens
  Light chain CDR3 for antibody 3744 (IGKV1-9)
QQLDSHPFT

SEQ ID NO: 7488 - protein, 17 aa, Homo sapiens
  Heavy chain CDR3 for antibody 3744 (IGHV3-33)
AREITMVRGDNYYGLDV

SEQ ID NO: 7489 - protein, 9 aa, Homo sapiens
  Light chain CDR3 for antibody 3745 (IGKV6-21)
HQSSSLPYT

SEQ ID NO: 7490 - protein, 14 aa, Homo sapiens
  Heavy chain CDR3 for antibody 3745 (IGHV1-18)
AREGYSGYLVYFDY

SEQ ID NO: 7491 - protein, 9 aa, Homo sapiens
  Light chain CDR3 for antibody 3746 (IGKV1-9)
HQLIGYPYT

SEQ ID NO: 7492 - protein, 15 aa, Homo sapiens
  Heavy chain CDR3 for antibody 3746 (IGHV1-46)
AREKYSGSGSYPFDY

SEQ ID NO: 7493 - protein, 9 aa, Homo sapiens
  Light chain CDR3 for antibody 3747 (IGKV1-9)
QQFNSHPFT

SEQ ID NO: 7494 - protein, 17 aa, Homo sapiens
  Heavy chain CDR3 for antibody 3747 (IGHV3-33)
AREITLVRGDNYYGMDV

SEQ ID NO: 7495 - protein, 9 aa, Homo sapiens
  Light chain CDR3 for antibody 3748 (IGKV1-9)
QQFNSHPFT

SEQ ID NO: 7496 - protein, 15 aa, Homo sapiens
  Heavy chain CDR3 for antibody 3748 (IGHV1-46)
AREKYYGSGSYPFDY

SEQ ID NO: 7497 - protein, 9 aa, Homo sapiens
  Light chain CDR3 for antibody 3749 (IGKV1-9)
QQLNSYPYT

SEQ ID NO: 7498 - protein, 16 aa, Homo sapiens
  Heavy chain CDR3 for antibody 3749 (IGHV1-18)
AREGDTMVRGVIAFDY

SEQ ID NO: 7499 - protein, 9 aa, Homo sapiens
  Light chain CDR3 for antibody 3750 (IGKV1-9)
QQLNSYPYT

SEQ ID NO: 7500 - protein, 13 aa, Homo sapiens
  Heavy chain CDR3 for antibody 3750 (IGHV1-46)
AREGGSYYVSFDY

SEQ ID NO: 7501 - protein, 9 aa, Homo sapiens
  Light chain CDR3 for antibody 3751 (IGKV1-9)
QQFNSYPFT

SEQ ID NO: 7502 - protein, 17 aa, Homo sapiens
  Heavy chain CDR3 for antibody 3751 (IGHV3-11)
AREITMVRGDNYYGFDY

SEQ ID NO: 7503 - protein, 9 aa, Homo sapiens
  Light chain CDR3 for antibody 3752 (IGKV1-9)
QQLNGYPYT

SEQ ID NO: 7504 - protein, 15 aa, Homo sapiens
  Heavy chain CDR3 for antibody 3752 (IGHV1-46)
AREKSYGSGSYPFDS

SEQ ID NO: 7505 - protein, 9 aa, Homo sapiens
  Light chain CDR3 for antibody 3753 (IGKV1D-17)
LQHNSYPYT

SEQ ID NO: 7506 - protein, 15 aa, Homo sapiens
  Heavy chain CDR3 for antibody 3753 (IGHV1-46)
AREKYYGSGSYPFDY

SEQ ID NO: 7507 - protein, 9 aa, Homo sapiens
  Light chain CDR3 for antibody 3754 (IGKV1D-17)
LQHNSYPYT

SEQ ID NO: 7508 - protein, 10 aa, Homo sapiens
  Heavy chain CDR3 for antibody 3754 (IGHV3-33)
AREGTDGFDP

SEQ ID NO: 7509 - protein, 9 aa, Homo sapiens
  Light chain CDR3 for antibody 3755 (IGKV1-9)
QQLNGFPYT

SEQ ID NO: 7510 - protein, 17 aa, Homo sapiens
  Heavy chain CDR3 for antibody 3755 (IGHV3-33)
AREITMVRGDNYYGMDV

SEQ ID NO: 7511 - protein, 9 aa, Homo sapiens
  Light chain CDR3 for antibody 3756 (IGKV1-9)
QQLNSHPFT

SEQ ID NO: 7512 - protein, 17 aa, Homo sapiens
  Heavy chain CDR3 for antibody 3756 (IGHV3-33)
VREISLVRGDNYYGLDV

SEQ ID NO: 7513 - protein, 9 aa, Homo sapiens
  Light chain CDR3 for antibody 3757 (IGKV1D-17)
LQHNSYPYT

SEQ ID NO: 7514 - protein, 10 aa, Homo sapiens
  Heavy chain CDR3 for antibody 3757 (IGHV3-33)
ARESGEGFDP

SEQ ID NO: 7515 - protein, 8 aa, Homo sapiens
  Light chain CDR3 for antibody 3758 (IGKV3D-20)
QQYGSSWT

SEQ ID NO: 7516 - protein, 11 aa, Homo sapiens
  Heavy chain CDR3 for antibody 3758 (IGHV3-33)
ARDGYSSGWDY

SEQ ID NO: 7517 - protein, 9 aa, Homo sapiens
  Light chain CDR3 for antibody 3759 (IGKV1-9)
QQLNSYPYT

SEQ ID NO: 7518 - protein, 11 aa, Homo sapiens
  Heavy chain CDR3 for antibody 3759 (IGHV3-33)
AREWQWLAPDY

SEQ ID NO: 7519 - protein, 9 aa, Homo sapiens
  Light chain CDR3 for antibody 3760 (IGKV1-17)
LQHNTYPRT

SEQ ID NO: 7520 - protein, 14 aa, Homo sapiens
  Heavy chain CDR3 for antibody 3760 (IGHV4-59)
ARDYGSGSYYTFDY

SEQ ID NO: 7521 - protein, 9 aa, Homo sapiens
  Light chain CDR3 for antibody 3761 (IGKV6-21)
HQSSSLPYT

SEQ ID NO: 7522 - protein, 17 aa, Homo sapiens
  Heavy chain CDR3 for antibody 3761 (IGHV3-33)
AREITMVRGDNYYGMDV

SEQ ID NO: 7523 - protein, 9 aa, Homo sapiens
  Light chain CDR3 for antibody 3762 (IGKV1-16)
QQYNSYPYT

SEQ ID NO: 7524 - protein, 15 aa, Homo sapiens
  Heavy chain CDR3 for antibody 3762 (IGHV1-18)
AATVTTSYYYYGMDV

SEQ ID NO: 7525 - protein, 9 aa, Homo sapiens
  Light chain CDR3 for antibody 3763 (IGKV1-6)
LQDYNYPWT

SEQ ID NO: 7526 - protein, 15 aa, Homo sapiens
  Heavy chain CDR3 for antibody 3763 (IGHV1-46)
AREKYYGSGSYPFDY

SEQ ID NO: 7527 - protein, 9 aa, Homo sapiens
  Light chain CDR3 for antibody 3764 (IGKV1-6)
LQDYNYPRT

SEQ ID NO: 7528 - protein, 13 aa, Homo sapiens
  Heavy chain CDR3 for antibody 3764 (IGHV1-18)
AREGGNYYVSFDH

SEQ ID NO: 7529 - protein, 9 aa, Homo sapiens
  Light chain CDR3 for antibody 3765 (IGKV1-9)
QQLNGYPYT

SEQ ID NO: 7530 - protein, 10 aa, Homo sapiens
  Heavy chain CDR3 for antibody 3765 (IGHV3-33)
ARESVAGFDY

SEQ ID NO: 7531 - protein, 9 aa, Homo sapiens
  Light chain CDR3 for antibody 3766 (IGKV1D-13)
QQFNNYPRT

SEQ ID NO: 7532 - protein, 16 aa, Homo sapiens
  Heavy chain CDR3 for antibody 3766 (IGHV3-33)
ARFGYSYGYDYCGMDV

SEQ ID NO: 7533 - protein, 9 aa, Homo sapiens
  Light chain CDR3 for antibody 3767 (IGKV1-17)
LQHNSYPFT

SEQ ID NO: 7534 - protein, 13 aa, Homo sapiens
  Heavy chain CDR3 for antibody 3767 (IGHV1-46)
ARGTGTTGGSFDY

SEQ ID NO: 7535 - protein, 9 aa, Homo sapiens
  Light chain CDR3 for antibody 3768 (IGKV1-12)
QQANSFPWT

SEQ ID NO: 7536 - protein, 19 aa, Homo sapiens
  Heavy chain CDR3 for antibody 3768 (IGHV1-18)
ARDHGYCSSTSCYRAWFDP

SEQ ID NO: 7537 - protein, 9 aa, Homo sapiens
  Light chain CDR3 for antibody 3769 (IGKV6-21)
HQSSSLPYT

SEQ ID NO: 7538 - protein, 9 aa, Homo sapiens
  Heavy chain CDR3 for antibody 3769 (IGHV3-23)
AKDELGIDY

SEQ ID NO: 7539 - protein, 9 aa, Homo sapiens
  Light chain CDR3 for antibody 3770 (IGKV1-9)
HQLISYPYT

SEQ ID NO: 7540 - protein, 15 aa, Homo sapiens
  Heavy chain CDR3 for antibody 3770 (IGHV1-46)
AREKYYGLGSYPFDC

SEQ ID NO: 7541 - protein, 9 aa, Homo sapiens
  Light chain CDR3 for antibody 3771 (IGKV1-9)
QHLNSYPFT

SEQ ID NO: 7542 - protein, 17 aa, Homo sapiens
  Heavy chain CDR3 for antibody 3771 (IGHV3-33)
ASEITLVRGDNYYGMDV

SEQ ID NO: 7543 - protein, 9 aa, Homo sapiens
  Light chain CDR3 for antibody 3772 (IGKV1-9)
QQLNGYPYT

SEQ ID NO: 7544 - protein, 15 aa, Homo sapiens
  Heavy chain CDR3 for antibody 3772 (IGHV1-46)
AREKYYGAGSYPFDY

SEQ ID NO: 7545 - protein, 9 aa, Homo sapiens
  Light chain CDR3 for antibody 3773 (IGKV1-9)
QQLNSYPLT

SEQ ID NO: 7546 - protein, 19 aa, Homo sapiens
  Heavy chain CDR3 for antibody 3773 (IGHV4-59)
AREVRDILTGYNYYYGMDV

SEQ ID NO: 7547 - protein, 9 aa, Homo sapiens
  Light chain CDR3 for antibody 3774 (IGKV1-9)
QQLNGYPYT

SEQ ID NO: 7548 - protein, 15 aa, Homo sapiens
  Heavy chain CDR3 for antibody 3774 (IGHV1-46)
AREKFSGSGSYPFDY

SEQ ID NO: 7549 - protein, 8 aa, Homo sapiens
  Light chain CDR3 for antibody 3775 (IGKV3-15)
QQYNNWWT

SEQ ID NO: 7550 - protein, 10 aa, Homo sapiens
  Heavy chain CDR3 for antibody 3775 (IGHV3-23)
AKDDWGYFDY

SEQ ID NO: 7551 - protein, 9 aa, Homo sapiens
  Light chain CDR3 for antibody 3776 (IGKV1-6)
LQDYNYPWT

SEQ ID NO: 7552 - protein, 13 aa, Homo sapiens
  Heavy chain CDR3 for antibody 3776 (IGHV1-18)
AREGGSFYVSFDY

SEQ ID NO: 7553 - protein, 10 aa, Homo sapiens
  Light chain CDR3 for antibody 3777 (IGKV1-9)
QQLNSYPPWT

SEQ ID NO: 7554 - protein, 17 aa, Homo sapiens
  Heavy chain CDR3 for antibody 3777 (IGHV3-33)
AREITMVRGDNYYGMDV

SEQ ID NO: 7555 - protein, 9 aa, Homo sapiens
  Light chain CDR3 for antibody 3778 (IGKV1D-16)
QQYNSYPRT

SEQ ID NO: 7556 - protein, 16 aa, Homo sapiens
  Heavy chain CDR3 for antibody 3778 (IGHV1-46)
ARDGNPENYYYYGMDV

SEQ ID NO: 7557 - protein, 9 aa, Homo sapiens
  Light chain CDR3 for antibody 3779 (IGKV1-9)
QRLNSYPYT

SEQ ID NO: 7558 - protein, 13 aa, Homo sapiens
  Heavy chain CDR3 for antibody 3779 (IGHV3-33)
ARDYCGGDCYTDP

SEQ ID NO: 7559 - protein, 9 aa, Homo sapiens
  Light chain CDR3 for antibody 3780 (IGKV6-21)
HQSSSLPYT

SEQ ID NO: 7560 - protein, 10 aa, Homo sapiens
  Heavy chain CDR3 for antibody 3780 (IGHV3-33)
ARESVAGFDY

SEQ ID NO: 7561 - protein, 9 aa, Homo sapiens
  Light chain CDR3 for antibody 3781 (IGKV6-21)
HQSSSLPYT

SEQ ID NO: 7562 - protein, 13 aa, Homo sapiens
  Heavy chain CDR3 for antibody 3781 (IGHV1-18)
AREGGSFYVSFDY

SEQ ID NO: 7563 - protein, 9 aa, Homo sapiens
  Light chain CDR3 for antibody 3782 (IGKV1-9)
QQLNSYPFT

SEQ ID NO: 7564 - protein, 17 aa, Homo sapiens
  Heavy chain CDR3 for antibody 3782 (IGHV3-33)
VREVTMVRGDNYYGIDV

SEQ ID NO: 7565 - protein, 9 aa, Homo sapiens
  Light chain CDR3 for antibody 3783 (IGKV1-6)
LQDYNYPWT

SEQ ID NO: 7566 - protein, 13 aa, Homo sapiens
  Heavy chain CDR3 for antibody 3783 (IGHV3-13)
ARGGWELFDAFDI

SEQ ID NO: 7567 - protein, 9 aa, Homo sapiens
  Light chain CDR3 for antibody 3784 (IGKV3D-20)
QQYGSSPYT

SEQ ID NO: 7568 - protein, 16 aa, Homo sapiens
  Heavy chain CDR3 for antibody 3784 (IGHV3-33)
ARIAAAGYYYYYGMDV

SEQ ID NO: 7569 - protein, 9 aa, Homo sapiens
  Light chain CDR3 for antibody 3785 (IGKV1-9)
QQLNGFPYT

SEQ ID NO: 7570 - protein, 10 aa, Homo sapiens
  Heavy chain CDR3 for antibody 3785 (IGHV3-33)
ARESTDGMDV

SEQ ID NO: 7571 - protein, 9 aa, Homo sapiens
  Light chain CDR3 for antibody 3786 (IGKV1-9)
QQLNSYPFT

SEQ ID NO: 7572 - protein, 17 aa, Homo sapiens
  Heavy chain CDR3 for antibody 3786 (IGHV3-33)
ARESTMVRGDNYYGLDA

SEQ ID NO: 7573 - protein, 9 aa, Homo sapiens
  Light chain CDR3 for antibody 3787 (IGKV1-27)
QKYNSAPYT

SEQ ID NO: 7574 - protein, 13 aa, Homo sapiens
  Heavy chain CDR3 for antibody 3787 (IGHV1-18)
AREGGSYYVSFDY

SEQ ID NO: 7575 - protein, 9 aa, Homo sapiens
  Light chain CDR3 for antibody 3788 (IGKV1D-13)
QQFNNYMYT

SEQ ID NO: 7576 - protein, 13 aa, Homo sapiens
  Heavy chain CDR3 for antibody 3788 (IGHV3-33)
ARGGVRGVIGFDY

SEQ ID NO: 7577 - protein, 9 aa, Homo sapiens
  Light chain CDR3 for antibody 3789 (IGKV1-9)
QQLNSYPYT

SEQ ID NO: 7578 - protein, 16 aa, Homo sapiens
  Heavy chain CDR3 for antibody 3789 (IGHV1-24)
ATEGAVAGYYYYGMDV

SEQ ID NO: 7579 - protein, 9 aa, Homo sapiens
  Light chain CDR3 for antibody 3790 (IGKV1-9)
QQFNSYPFT

SEQ ID NO: 7580 - protein, 17 aa, Homo sapiens
  Heavy chain CDR3 for antibody 3790 (IGHV3-30)
AREITMVRGDNYYGLDV

SEQ ID NO: 7581 - protein, 9 aa, Homo sapiens
  Light chain CDR3 for antibody 3791 (IGKV1-27)
QKYNSAPWT

SEQ ID NO: 7582 - protein, 10 aa, Homo sapiens
  Heavy chain CDR3 for antibody 3791 (IGHV3-33)
AREAVAGFDY

SEQ ID NO: 7583 - protein, 9 aa, Homo sapiens
  Light chain CDR3 for antibody 3792 (IGKV1-5)
QQYNSYSRT

SEQ ID NO: 7584 - protein, 12 aa, Homo sapiens
  Heavy chain CDR3 for antibody 3792 (IGHV3-20)
ARDWGDGDYFDY

SEQ ID NO: 7585 - protein, 9 aa, Homo sapiens
  Light chain CDR3 for antibody 3793 (IGKV1-9)
QQLNSYPYT

SEQ ID NO: 7586 - protein, 15 aa, Homo sapiens
  Heavy chain CDR3 for antibody 3793 (IGHV1-46)
AREKSYGSGTSPFDY

SEQ ID NO: 7587 - protein, 9 aa, Homo sapiens
  Light chain CDR3 for antibody 3794 (IGKV1-27)
QKYNSAPFT

SEQ ID NO: 7588 - protein, 16 aa, Homo sapiens
  Heavy chain CDR3 for antibody 3794 (IGHV1-46)
ASRITGTYYYYYGMDV

SEQ ID NO: 7589 - protein, 9 aa, Homo sapiens
  Light chain CDR3 for antibody 3795 (IGKV1-9)
QQLNSYPFT

SEQ ID NO: 7590 - protein, 9 aa, Homo sapiens
  Heavy chain CDR3 for antibody 3795 (IGHV3-33)
ARTLLYFDY

SEQ ID NO: 7591 - protein, 9 aa, Homo sapiens
  Light chain CDR3 for antibody 3796 (IGKV1-6)
LQDYNYPRT

SEQ ID NO: 7592 - protein, 9 aa, Homo sapiens
  Heavy chain CDR3 for antibody 3796 (IGHV1-18)
ARDWGSFDY

SEQ ID NO: 7593 - protein, 9 aa, Homo sapiens
  Light chain CDR3 for antibody 3797 (IGKV1D-13)
QQFNNYMYT

SEQ ID NO: 7594 - protein, 10 aa, Homo sapiens
  Heavy chain CDR3 for antibody 3797 (IGHV3-48)
ARESTDGMDV

SEQ ID NO: 7595 - protein, 9 aa, Homo sapiens
  Light chain CDR3 for antibody 3798 (IGKV5-2)
LQHDNFPWT

SEQ ID NO: 7596 - protein, 10 aa, Homo sapiens
  Heavy chain CDR3 for antibody 3798 (IGHV3-33)
AREGVGGMDV

SEQ ID NO: 7597 - protein, 9 aa, Homo sapiens
  Light chain CDR3 for antibody 3799 (IGKV1-9)
QQLNSYPPT

SEQ ID NO: 7598 - protein, 14 aa, Homo sapiens
  Heavy chain CDR3 for antibody 3799 (IGHV4-59)
AREGMQLWPTAFDI

SEQ ID NO: 7599 - protein, 9 aa, Homo sapiens
  Light chain CDR3 for antibody 3800 (IGKV1-9)
QQLNSYPYT

SEQ ID NO: 7600 - protein, 11 aa, Homo sapiens
  Heavy chain CDR3 for antibody 3800 (IGHV3-64)
ARGLHYYGMDV

SEQ ID NO: 7601 - protein, 10 aa, Homo sapiens
  Light chain CDR3 for antibody 3801 (IGKV3D-20)
QQYGSSLTWT

SEQ ID NO: 7602 - protein, 14 aa, Homo sapiens
  Heavy chain CDR3 for antibody 3801 (IGHV3-33)
ARGARYFDYYGMDV

SEQ ID NO: 7603 - protein, 9 aa, Homo sapiens
  Light chain CDR3 for antibody 3802 (IGKV6-21)
HQSSSLPYT

SEQ ID NO: 7604 - protein, 10 aa, Homo sapiens
  Heavy chain CDR3 for antibody 3802 (IGHV3-33)
ARESTDGMDV

SEQ ID NO: 7605 - protein, 9 aa, Homo sapiens
  Light chain CDR3 for antibody 3803 (IGKV3-11)
QQRSNWPRT

SEQ ID NO: 7606 - protein, 9 aa, Homo sapiens
  Heavy chain CDR3 for antibody 3803 (IGHV3-23)
AKGLGIFDY

SEQ ID NO: 7607 - protein, 9 aa, Homo sapiens
  Light chain CDR3 for antibody 3804 (IGKV1-9)
QQLNSYPYT

SEQ ID NO: 7608 - protein, 11 aa, Homo sapiens
  Heavy chain CDR3 for antibody 3804 (IGHV4-34)
ARPGTGDAFDI

SEQ ID NO: 7609 - protein, 9 aa, Homo sapiens
  Light chain CDR3 for antibody 3805 (IGKV1-9)
QQLNGFPYT

SEQ ID NO: 7610 - protein, 15 aa, Homo sapiens
  Heavy chain CDR3 for antibody 3805 (IGHV1-46)
AREGLTGYYPNWFDP

SEQ ID NO: 7611 - protein, 9 aa, Homo sapiens
  Light chain CDR3 for antibody 3806 (IGKV3-11)
QQRSNWLFT

SEQ ID NO: 7612 - protein, 15 aa, Homo sapiens
  Heavy chain CDR3 for antibody 3806 (IGHV1-46)
ARDIVVVPAYSAFDI

SEQ ID NO: 7613 - protein, 9 aa, Homo sapiens
  Light chain CDR3 for antibody 3807 (IGKV1-9)
QQFNSHPFT

SEQ ID NO: 7614 - protein, 13 aa, Homo sapiens
  Heavy chain CDR3 for antibody 3807 (IGHV3-33)
ARDYCSGDCYPDP

SEQ ID NO: 7615 - protein, 9 aa, Homo sapiens
  Light chain CDR3 for antibody 3808 (IGKV1-9)
QQLNGYPYT

SEQ ID NO: 7616 - protein, 15 aa, Homo sapiens
  Heavy chain CDR3 for antibody 3808 (IGHV1-46)
AREKYYVSGSYPFAY

SEQ ID NO: 7617 - protein, 9 aa, Homo sapiens
  Light chain CDR3 for antibody 3809 (IGKV1-9)
QQLNGYPYT

SEQ ID NO: 7618 - protein, 9 aa, Homo sapiens
  Heavy chain CDR3 for antibody 3809 (IGHV1-46)
ARANWAPDY

SEQ ID NO: 7619 - protein, 9 aa, Homo sapiens
  Light chain CDR3 for antibody 3810 (IGKV1D-13)
QQFNNYMYT

SEQ ID NO: 7620 - protein, 16 aa, Homo sapiens
  Heavy chain CDR3 for antibody 3810 (IGHV1-18)
AREGDTMVRGVIAFDY

SEQ ID NO: 7621 - protein, 9 aa, Homo sapiens
  Light chain CDR3 for antibody 3811 (IGKV1-9)
QQLNGYPYT

SEQ ID NO: 7622 - protein, 15 aa, Homo sapiens
  Heavy chain CDR3 for antibody 3811 (IGHV1-46)
AREKDYGSGSYAFDY

SEQ ID NO: 7623 - protein, 9 aa, Homo sapiens
  Light chain CDR3 for antibody 3812 (IGKV1D-13)
QQFNNYPRT

SEQ ID NO: 7624 - protein, 13 aa, Homo sapiens
  Heavy chain CDR3 for antibody 3812 (IGHV1-24)
ATDRYSGRNYFDY

SEQ ID NO: 7625 - protein, 9 aa, Homo sapiens
  Light chain CDR3 for antibody 3813 (IGKV1D-13)
QQFNNYPRT

SEQ ID NO: 7626 - protein, 10 aa, Homo sapiens
  Heavy chain CDR3 for antibody 3813 (IGHV3-33)
AREAVAGFDY

SEQ ID NO: 7627 - protein, 9 aa, Homo sapiens
  Light chain CDR3 for antibody 3814 (IGKV1D-16)
QQYNSYPLT

SEQ ID NO: 7628 - protein, 15 aa, Homo sapiens
  Heavy chain CDR3 for antibody 3814 (IGHV3-33)
ARNYDILTGYSPFDY

SEQ ID NO: 7629 - protein, 8 aa, Homo sapiens
  Light chain CDR3 for antibody 3815 (IGKV3-20)
QQYGSSFT

SEQ ID NO: 7630 - protein, 19 aa, Homo sapiens
  Heavy chain CDR3 for antibody 3815 (IGHV3-33)
ARDPNDILTGSFYYYGMDV

SEQ ID NO: 7631 - protein, 9 aa, Homo sapiens
  Light chain CDR3 for antibody 3816 (IGKV1-9)
QQLNSYPFT

SEQ ID NO: 7632 - protein, 10 aa, Homo sapiens
  Heavy chain CDR3 for antibody 3816 (IGHV3-33)
AREATEGFDY

SEQ ID NO: 7633 - protein, 9 aa, Homo sapiens
  Light chain CDR3 for antibody 3817 (IGKV1-9)
QQLNSYPRT

SEQ ID NO: 7634 - protein, 14 aa, Homo sapiens
  Heavy chain CDR3 for antibody 3817 (IGHV4-59)
ARESRVRAYWYFDL

SEQ ID NO: 7635 - protein, 9 aa, Homo sapiens
  Light chain CDR3 for antibody 3818 (IGKV1-6)
LQDYNYPWT

SEQ ID NO: 7636 - protein, 18 aa, Homo sapiens
  Heavy chain CDR3 for antibody 3818 (IGHV3-11)
ARDSSSWYPYYYYYGMDV

SEQ ID NO: 7637 - protein, 9 aa, Homo sapiens
  Light chain CDR3 for antibody 3819 (IGKV1-9)
QQLNGYPYT

SEQ ID NO: 7638 - protein, 15 aa, Homo sapiens
  Heavy chain CDR3 for antibody 3819 (IGHV1-46)
AREKYYGSGRDPFDY

SEQ ID NO: 7639 - protein, 9 aa, Homo sapiens
  Light chain CDR3 for antibody 3820 (IGKV1-6)
LQDYNYPYT

SEQ ID NO: 7640 - protein, 10 aa, Homo sapiens
  Heavy chain CDR3 for antibody 3820 (IGHV3-33)
ARESVAGFDY

SEQ ID NO: 7641 - protein, 9 aa, Homo sapiens
  Light chain CDR3 for antibody 3821 (IGKV1-9)
QQLNGYPYT

SEQ ID NO: 7642 - protein, 15 aa, Homo sapiens
  Heavy chain CDR3 for antibody 3821 (IGHV1-46)
AREKCYGSASYPFDY

SEQ ID NO: 7643 - protein, 9 aa, Homo sapiens
  Light chain CDR3 for antibody 3822 (IGKV1-9)
HQLISYPYT

SEQ ID NO: 7644 - protein, 17 aa, Homo sapiens
  Heavy chain CDR3 for antibody 3822 (IGHV3-33)
AREITMVRGDNYYGMDV

SEQ ID NO: 7645 - protein, 9 aa, Homo sapiens
  Light chain CDR3 for antibody 3823 (IGKV1-39)
QQSYSTPYT

SEQ ID NO: 7646 - protein, 15 aa, Homo sapiens
  Heavy chain CDR3 for antibody 3823 (IGHV1-46)
AREKYYGSGSYPFDY

SEQ ID NO: 7647 - protein, 9 aa, Homo sapiens
  Light chain CDR3 for antibody 3824 (IGKV1D-17)
LQHNSYPYT

SEQ ID NO: 7648 - protein, 15 aa, Homo sapiens
  Heavy chain CDR3 for antibody 3824 (IGHV1-46)
AREGLTGYYPNWFDP

SEQ ID NO: 7649 - protein, 9 aa, Homo sapiens
  Light chain CDR3 for antibody 3825 (IGKV1-6)
LQDYNYPWT

SEQ ID NO: 7650 - protein, 15 aa, Homo sapiens
  Heavy chain CDR3 for antibody 3825 (IGHV1-46)
ARDLVVVPAAMGFDY

SEQ ID NO: 7651 - protein, 9 aa, Homo sapiens
  Light chain CDR3 for antibody 3826 (IGKV4-1)
QQYYSTPPT

SEQ ID NO: 7652 - protein, 12 aa, Homo sapiens
  Heavy chain CDR3 for antibody 3826 (IGHV4-61)
ARDTSSGWFFDY

SEQ ID NO: 7653 - protein, 9 aa, Homo sapiens
  Light chain CDR3 for antibody 3827 (IGKV1-9)
QQLNSYPWT

SEQ ID NO: 7654 - protein, 13 aa, Homo sapiens
  Heavy chain CDR3 for antibody 3827 (IGHV3-33)
AREYCGGDCYGDY

SEQ ID NO: 7655 - protein, 9 aa, Homo sapiens
  Light chain CDR3 for antibody 3828 (IGKV6-21)
HQSSSLPHT

SEQ ID NO: 7656 - protein, 14 aa, Homo sapiens
  Heavy chain CDR3 for antibody 3828 (IGHV3-11)
AREEDIVATSYFDY

SEQ ID NO: 7657 - protein, 9 aa, Homo sapiens
  Light chain CDR3 for antibody 3829 (IGKV1-9)
QQLNSYPFT

SEQ ID NO: 7658 - protein, 17 aa, Homo sapiens
  Heavy chain CDR3 for antibody 3829 (IGHV3-33)
AREITLVRGDNYYGLDV

SEQ ID NO: 7659 - protein, 9 aa, Homo sapiens
  Light chain CDR3 for antibody 3830 (IGKV1-9)
QQLNSYPFT

SEQ ID NO: 7660 - protein, 19 aa, Homo sapiens
  Heavy chain CDR3 for antibody 3830 (IGHV3-33)
ARDPNDILTGSFYYYGMDV

SEQ ID NO: 7661 - protein, 9 aa, Homo sapiens
  Light chain CDR3 for antibody 3831 (IGKV1-9)
QQLNSYPFT

SEQ ID NO: 7662 - protein, 10 aa, Homo sapiens
  Heavy chain CDR3 for antibody 3831 (IGHV3-33)
ARESGEGFDP

SEQ ID NO: 7663 - protein, 9 aa, Homo sapiens
  Light chain CDR3 for antibody 3832 (IGKV1D-17)
LQHNSYPWT

SEQ ID NO: 7664 - protein, 15 aa, Homo sapiens
  Heavy chain CDR3 for antibody 3832 (IGHV1-8)
ARRATTGYYYYGMDV

SEQ ID NO: 7665 - protein, 9 aa, Homo sapiens
  Light chain CDR3 for antibody 3833 (IGKV1-9)
QQLNSYPYT

SEQ ID NO: 7666 - protein, 14 aa, Homo sapiens
  Heavy chain CDR3 for antibody 3833 (IGHV3-23)
AKDRAVAGTYYFDY

SEQ ID NO: 7667 - protein, 9 aa, Homo sapiens
  Light chain CDR3 for antibody 3834 (IGKV1-17)
LQHNSYPYT

SEQ ID NO: 7668 - protein, 20 aa, Homo sapiens
  Heavy chain CDR3 for antibody 3834 (IGHV3-11)
ASQLLWFGELLGDYYYGMDV

SEQ ID NO: 7669 - protein, 9 aa, Homo sapiens
  Light chain CDR3 for antibody 3835 (IGKV1-37)
QRTYNAPYT

SEQ ID NO: 7670 - protein, 11 aa, Homo sapiens
  Heavy chain CDR3 for antibody 3835 (IGHV3-33)
ARNYYYYGMDV

SEQ ID NO: 7671 - protein, 9 aa, Homo sapiens
  Light chain CDR3 for antibody 3836 (IGKV1D-16)
QQYNSYPYT

SEQ ID NO: 7672 - protein, 10 aa, Homo sapiens
  Heavy chain CDR3 for antibody 3836 (IGHV3-33)
ASRLVNLFDY

SEQ ID NO: 7673 - protein, 9 aa, Homo sapiens
  Light chain CDR3 for antibody 3837 (IGKV6-21)
HQSSSLPWT

SEQ ID NO: 7674 - protein, 12 aa, Homo sapiens
  Heavy chain CDR3 for antibody 3837 (IGHV4-39)
ASDGSGSYSYDY

SEQ ID NO: 7675 - protein, 9 aa, Homo sapiens
  Light chain CDR3 for antibody 3838 (IGKV1-9)
QQLNSYPYT

SEQ ID NO: 7676 - protein, 15 aa, Homo sapiens
  Heavy chain CDR3 for antibody 3838 (IGHV1-46)
AREKSHGSGSYPFAY

SEQ ID NO: 7677 - protein, 9 aa, Homo sapiens
  Light chain CDR3 for antibody 3839 (IGKV1-9)
QQLNGYPYT

SEQ ID NO: 7678 - protein, 15 aa, Homo sapiens
  Heavy chain CDR3 for antibody 3839 (IGHV1-46)
AREKYYGSGSSPFAS

SEQ ID NO: 7679 - protein, 9 aa, Homo sapiens
  Light chain CDR3 for antibody 3840 (IGKV6-21)
HQSSSLPYT

SEQ ID NO: 7680 - protein, 15 aa, Homo sapiens
  Heavy chain CDR3 for antibody 3840 (IGHV1-46)
AREGLTGYYPNWFDP

SEQ ID NO: 7681 - protein, 9 aa, Homo sapiens
  Light chain CDR3 for antibody 3841 (IGKV1-9)
QQLNGYPYT

SEQ ID NO: 7682 - protein, 15 aa, Homo sapiens
  Heavy chain CDR3 for antibody 3841 (IGHV1-46)
AREKYDGSWSYPFDY

SEQ ID NO: 7683 - protein, 9 aa, Homo sapiens
  Light chain CDR3 for antibody 3842 (IGKV1-12)
LQDYNYPRT

SEQ ID NO: 7684 - protein, 16 aa, Homo sapiens
  Heavy chain CDR3 for antibody 3842 (IGHV1-46)
ARGFVVVPAAVDAFDI

SEQ ID NO: 7685 - protein, 9 aa, Homo sapiens
  Light chain CDR3 for antibody 3843 (IGKV1-9)
QQLNGFPYT

SEQ ID NO: 7686 - protein, 13 aa, Homo sapiens
  Heavy chain CDR3 for antibody 3843 (IGHV1-18)
AREGGSYIVSFDY

SEQ ID NO: 7687 - protein, 9 aa, Homo sapiens
  Light chain CDR3 for antibody 3844 (IGKV1-9)
QQLNGYPYT

SEQ ID NO: 7688 - protein, 14 aa, Homo sapiens
  Heavy chain CDR3 for antibody 3844 (IGHV3-23)
AKDQIVATIGYFQH

SEQ ID NO: 7689 - protein, 9 aa, Homo sapiens
  Light chain CDR3 for antibody 3845 (IGKV1-9)
QQFNSHPFT

SEQ ID NO: 7690 - protein, 15 aa, Homo sapiens
  Heavy chain CDR3 for antibody 3845 (IGHV1-46)
AREGLTGYYPNWFDP

SEQ ID NO: 7691 - protein, 9 aa, Homo sapiens
  Light chain CDR3 for antibody 3846 (IGKV5-2)
LQHDNFPYT

SEQ ID NO: 7692 - protein, 11 aa, Homo sapiens
  Heavy chain CDR3 for antibody 3846 (IGHV3-33)
ARDGPLLAFDI

SEQ ID NO: 7693 - protein, 9 aa, Homo sapiens
  Light chain CDR3 for antibody 3847 (IGKV1-9)
QHLNSHPFT

SEQ ID NO: 7694 - protein, 17 aa, Homo sapiens
  Heavy chain CDR3 for antibody 3847 (IGHV3-33)
AREITMLRGDNYYGLDV

SEQ ID NO: 7695 - protein, 9 aa, Homo sapiens
  Light chain CDR3 for antibody 3848 (IGKV1-9)
QQLNGYPYT

SEQ ID NO: 7696 - protein, 15 aa, Homo sapiens
  Heavy chain CDR3 for antibody 3848 (IGHV1-46)
AIEKYYGSGSYPFDF

SEQ ID NO: 7697 - protein, 9 aa, Homo sapiens
  Light chain CDR3 for antibody 3849 (IGKV1D-17)
LQHNSYPYT

SEQ ID NO: 7698 - protein, 14 aa, Homo sapiens
  Heavy chain CDR3 for antibody 3849 (IGHV3-33)
ARGGVLRYFDWLLG

SEQ ID NO: 7699 - protein, 9 aa, Homo sapiens
  Light chain CDR3 for antibody 3850 (IGKV1-9)
QQLNGYPYT

SEQ ID NO: 7700 - protein, 9 aa, Homo sapiens
  Heavy chain CDR3 for antibody 3850 (IGHV3-23)
AKEAVAGDY

SEQ ID NO: 7701 - protein, 9 aa, Homo sapiens
  Light chain CDR3 for antibody 3851 (IGKV1-9)
QQLNSYPYT

SEQ ID NO: 7702 - protein, 17 aa, Homo sapiens
  Heavy chain CDR3 for antibody 3851 (IGHV3-33)
AREITMARGDNSYGMDV

SEQ ID NO: 7703 - protein, 9 aa, Homo sapiens
  Light chain CDR3 for antibody 3852 (IGKV1D-17)
LQHNSYPLT

SEQ ID NO: 7704 - protein, 13 aa, Homo sapiens
  Heavy chain CDR3 for antibody 3852 (IGHV1-46)
AREGGNYIVSFDY

SEQ ID NO: 7705 - protein, 9 aa, Homo sapiens
  Light chain CDR3 for antibody 3853 (IGKV1-6)
LQDYNYPYT

SEQ ID NO: 7706 - protein, 14 aa, Homo sapiens
  Heavy chain CDR3 for antibody 3853 (IGHV1-24)
ATAGILTGSDAFDI

SEQ ID NO: 7707 - protein, 9 aa, Homo sapiens
  Light chain CDR3 for antibody 3854 (IGKV1-9)
QQLNSYPYT

SEQ ID NO: 7708 - protein, 14 aa, Homo sapiens
  Heavy chain CDR3 for antibody 3854 (IGHV1-46)
AREGEQQPFNWFDP

SEQ ID NO: 7709 - protein, 9 aa, Homo sapiens
  Light chain CDR3 for antibody 3855 (IGKV1-9)
QQLNSYPLT

SEQ ID NO: 7710 - protein, 12 aa, Homo sapiens
  Heavy chain CDR3 for antibody 3855 (IGHV3-33)
ARDRYSGSPLDY

SEQ ID NO: 7711 - protein, 9 aa, Homo sapiens
  Light chain CDR3 for antibody 3856 (IGKV1-9)
QQLNSYPYT

SEQ ID NO: 7712 - protein, 17 aa, Homo sapiens
  Heavy chain CDR3 for antibody 3856 (IGHV3-33)
AREINMVRGDNYYGMDA

SEQ ID NO: 7713 - protein, 9 aa, Homo sapiens
  Light chain CDR3 for antibody 3857 (IGKV1-16)
QQYNSYPWT

SEQ ID NO: 7714 - protein, 9 aa, Homo sapiens
  Heavy chain CDR3 for antibody 3857 (IGHV1-24)
ATASGDFDY

SEQ ID NO: 7715 - protein, 9 aa, Homo sapiens
  Light chain CDR3 for antibody 3858 (IGKV1-9)
QQLNSYPFT

SEQ ID NO: 7716 - protein, 17 aa, Homo sapiens
  Heavy chain CDR3 for antibody 3858 (IGHV3-30)
ARESTMVRGDNYYAMEV

SEQ ID NO: 7717 - protein, 9 aa, Homo sapiens
  Light chain CDR3 for antibody 3859 (IGKV1-9)
QQLNSYPFT

SEQ ID NO: 7718 - protein, 17 aa, Homo sapiens
  Heavy chain CDR3 for antibody 3859 (IGHV3-66)
ERESTMVRGYNYYGMDV

SEQ ID NO: 7719 - protein, 9 aa, Homo sapiens
  Light chain CDR3 for antibody 3860 (IGKV1-9)
QQLNSYPYT

SEQ ID NO: 7720 - protein, 15 aa, Homo sapiens
  Heavy chain CDR3 for antibody 3860 (IGHV1-46)
AREKYYGSATYPFDY

SEQ ID NO: 7721 - protein, 9 aa, Homo sapiens
  Light chain CDR3 for antibody 3861 (IGKV1-9)
QQLNSYPFT

SEQ ID NO: 7722 - protein, 10 aa, Homo sapiens
  Heavy chain CDR3 for antibody 3861 (IGHV3-33)
AREGTDGFDP

SEQ ID NO: 7723 - protein, 9 aa, Homo sapiens
  Light chain CDR3 for antibody 3862 (IGKV1-9)
QQLNGYPYT

SEQ ID NO: 7724 - protein, 15 aa, Homo sapiens
  Heavy chain CDR3 for antibody 3862 (IGHV1-46)
AREKSHGSGSYPIDY

SEQ ID NO: 7725 - protein, 9 aa, Homo sapiens
  Light chain CDR3 for antibody 3863 (IGKV1-9)
LLHTSYPYT

SEQ ID NO: 7726 - protein, 10 aa, Homo sapiens
  Heavy chain CDR3 for antibody 3863 (IGHV3-33)
AREAVAGFDY

SEQ ID NO: 7727 - protein, 9 aa, Homo sapiens
  Light chain CDR3 for antibody 3864 (IGKV1-9)
QQLNSYPYT

SEQ ID NO: 7728 - protein, 5 aa, Homo sapiens
  Heavy chain CDR3 for antibody 3864 (IGHV1-46)
AREKY

SEQ ID NO: 7729 - protein, 9 aa, Homo sapiens
  Light chain CDR3 for antibody 3865 (IGKV1-9)
QQLNSYPYT

SEQ ID NO: 7730 - protein, 15 aa, Homo sapiens
  Heavy chain CDR3 for antibody 3865 (IGHV1-46)
AREKYYGSGNYPIDS

SEQ ID NO: 7731 - protein, 9 aa, Homo sapiens
  Light chain CDR3 for antibody 3866 (IGKV1-9)
QQLNSYPYT

SEQ ID NO: 7732 - protein, 13 aa, Homo sapiens
  Heavy chain CDR3 for antibody 3866 (IGHV3-30)
ARDYCGGDYSPDP

SEQ ID NO: 7733 - protein, 9 aa, Homo sapiens
  Light chain CDR3 for antibody 3867 (IGKV1-9)
HQLISYPYT

SEQ ID NO: 7734 - protein, 10 aa, Homo sapiens
  Heavy chain CDR3 for antibody 3867 (IGHV3-33)
ARESVAGFDY

SEQ ID NO: 7735 - protein, 9 aa, Homo sapiens
  Light chain CDR3 for antibody 3868 (IGKV1-9)
QQLNSYPFT

SEQ ID NO: 7736 - protein, 12 aa, Homo sapiens
  Heavy chain CDR3 for antibody 3868 (IGHV3-23)
AKEGIAAAGLDY

SEQ ID NO: 7737 - protein, 9 aa, Homo sapiens
  Light chain CDR3 for antibody 3869 (IGKV1-9)
QQLNSYPYT

SEQ ID NO: 7738 - protein, 15 aa, Homo sapiens
  Heavy chain CDR3 for antibody 3869 (IGHV1-46)
AREKYYGAGSYAFDD

SEQ ID NO: 7739 - protein, 9 aa, Homo sapiens
  Light chain CDR3 for antibody 3870 (IGKV1-27)
QKYNSAPWT

SEQ ID NO: 7740 - protein, 12 aa, Homo sapiens
  Heavy chain CDR3 for antibody 3870 (IGHV1-46)
ARVASSWYYFDY

SEQ ID NO: 7741 - protein, 9 aa, Homo sapiens
  Light chain CDR3 for antibody 3871 (IGKV1-13)
QQLNSYPYT

SEQ ID NO: 7742 - protein, 14 aa, Homo sapiens
  Heavy chain CDR3 for antibody 3871 (IGHV3-33)
AREGLGIGGYGMDV

SEQ ID NO: 7743 - protein, 9 aa, Homo sapiens
  Light chain CDR3 for antibody 3872 (IGKV1-9)
QQLNGYPYT

SEQ ID NO: 7744 - protein, 15 aa, Homo sapiens
  Heavy chain CDR3 for antibody 3872 (IGHV1-46)
AREKYYGSGSSPFDY

SEQ ID NO: 7745 - protein, 8 aa, Homo sapiens
  Light chain CDR3 for antibody 3873 (IGKV3D-20)
QQYGSSWT

SEQ ID NO: 7746 - protein, 17 aa, Homo sapiens
  Heavy chain CDR3 for antibody 3873 (IGHV3-33)
AREITMLRGDNYYGLDV

SEQ ID NO: 7747 - protein, 9 aa, Homo sapiens
  Light chain CDR3 for antibody 3874 (IGKV1-9)
QQLNSYPYT

SEQ ID NO: 7748 - protein, 14 aa, Homo sapiens
  Heavy chain CDR3 for antibody 3874 (IGHV1-46)
AREGYSGYLVYFDY

SEQ ID NO: 7749 - protein, 9 aa, Homo sapiens
  Light chain CDR3 for antibody 3875 (IGKV1-9)
QQLNGYPYT

SEQ ID NO: 7750 - protein, 15 aa, Homo sapiens
  Heavy chain CDR3 for antibody 3875 (IGHV1-46)
AREKYYGLGSYPFDC

SEQ ID NO: 7751 - protein, 9 aa, Homo sapiens
  Light chain CDR3 for antibody 3876 (IGKV1-9)
QQLNGYPYT

SEQ ID NO: 7752 - protein, 14 aa, Homo sapiens
  Heavy chain CDR3 for antibody 3876 (IGHV1-18)
AREGYSGYLVYFDY

SEQ ID NO: 7753 - protein, 9 aa, Homo sapiens
  Light chain CDR3 for antibody 3877 (IGKV1-9)
QQLNSYPYT

SEQ ID NO: 7754 - protein, 14 aa, Homo sapiens
  Heavy chain CDR3 for antibody 3877 (IGHV4-59)
ARDYGSGSYYTFDY

SEQ ID NO: 7755 - protein, 9 aa, Homo sapiens
  Light chain CDR3 for antibody 3878 (IGKV1-12)
QQLNGYPYT

SEQ ID NO: 7756 - protein, 19 aa, Homo sapiens
  Heavy chain CDR3 for antibody 3878 (IGHV1-18)
ARDHGYCSSTSCYRAWFDP

SEQ ID NO: 7757 - protein, 9 aa, Homo sapiens
  Light chain CDR3 for antibody 3879 (IGKV1-39)
QQSFITPYT

SEQ ID NO: 7758 - protein, 20 aa, Homo sapiens
  Heavy chain CDR3 for antibody 3879 (IGHV4-59)
ARDRGSGSPPHYYYYYGMDV

SEQ ID NO: 7759 - protein, 9 aa, Homo sapiens
  Light chain CDR3 for antibody 3880 (IGKV1-9)
QQLNSYPYT

SEQ ID NO: 7760 - protein, 15 aa, Homo sapiens
  Heavy chain CDR3 for antibody 3880 (IGHV1-46)
ARENYYGSASSPFDY

SEQ ID NO: 7761 - protein, 9 aa, Homo sapiens
  Light chain CDR3 for antibody 3881 (IGKV1D-17)
QQLNSYPYT

SEQ ID NO: 7762 - protein, 13 aa, Homo sapiens
  Heavy chain CDR3 for antibody 3881 (IGHV1-46)
ARGTGTTGGSFDY

SEQ ID NO: 7763 - protein, 9 aa, Homo sapiens
  Light chain CDR3 for antibody 3882 (IGKV1D-13)
QQFNNYPLT

SEQ ID NO: 7764 - protein, 15 aa, Homo sapiens
  Heavy chain CDR3 for antibody 3882 (IGHV1-46)
AGPPYYDILTGYPRH

SEQ ID NO: 7765 - protein, 9 aa, Homo sapiens
  Light chain CDR3 for antibody 3883 (IGKV1-9)
QQLNGYPYT

SEQ ID NO: 7766 - protein, 15 aa, Homo sapiens
  Heavy chain CDR3 for antibody 3883 (IGHV1-46)
AGEEYYGSGSYPFDY

SEQ ID NO: 7767 - protein, 9 aa, Homo sapiens
  Light chain CDR3 for antibody 3884 (IGKV1-6)
LQDYNYPLT

SEQ ID NO: 7768 - protein, 15 aa, Homo sapiens
  Heavy chain CDR3 for antibody 3884 (IGHV3-66)
AREADYGDYPDAFDI

SEQ ID NO: 7769 - protein, 9 aa, Homo sapiens
  Light chain CDR3 for antibody 3885 (IGKV1-9)
QQFNSHPFT

SEQ ID NO: 7770 - protein, 13 aa, Homo sapiens
  Heavy chain CDR3 for antibody 3885 (IGHV3-33)
AREGGSYIVSFDY

SEQ ID NO: 7771 - protein, 9 aa, Homo sapiens
  Light chain CDR3 for antibody 3886 (IGKV3D-20)
QQYGSSPWT

SEQ ID NO: 7772 - protein, 17 aa, Homo sapiens
  Heavy chain CDR3 for antibody 3886 (IGHV3-20)
ARDYYGSGSYYNDAFDI

SEQ ID NO: 7773 - protein, 9 aa, Homo sapiens
  Light chain CDR3 for antibody 3887 (IGKV1-9)
QQFNSYPFT

SEQ ID NO: 7774 - protein, 17 aa, Homo sapiens
  Heavy chain CDR3 for antibody 3887 (IGHV3-33)
AREITMVRGDNHYGMDV

SEQ ID NO: 7775 - protein, 9 aa, Homo sapiens
  Light chain CDR3 for antibody 3888 (IGKV1-9)
QQLISYPYT

SEQ ID NO: 7776 - protein, 13 aa, Homo sapiens
  Heavy chain CDR3 for antibody 3888 (IGHV3-33)
ARDYCSGDCSTDP

SEQ ID NO: 7777 - protein, 9 aa, Homo sapiens
  Light chain CDR3 for antibody 3889 (IGKV1-6)
LQDYNYPWT

SEQ ID NO: 7778 - protein, 15 aa, Homo sapiens
  Heavy chain CDR3 for antibody 3889 (IGHV1-24)
ATQDIVVVPAAYFDY

SEQ ID NO: 7779 - protein, 9 aa, Homo sapiens
  Light chain CDR3 for antibody 3890 (IGKV1-9)
QQLNGYPYT

SEQ ID NO: 7780 - protein, 17 aa, Homo sapiens
  Heavy chain CDR3 for antibody 3890 (IGHV3-33)
AREITMVRGDNYYGLDV

SEQ ID NO: 7781 - protein, 9 aa, Homo sapiens
  Light chain CDR3 for antibody 3891 (IGKV1-9)
QQLNSYPFT

SEQ ID NO: 7782 - protein, 17 aa, Homo sapiens
  Heavy chain CDR3 for antibody 3891 (IGHV3-33)
AREITLVRGDNSYGLDA

SEQ ID NO: 7783 - protein, 9 aa, Homo sapiens
  Light chain CDR3 for antibody 3892 (IGKV1-9)
QQFNSFPFT

SEQ ID NO: 7784 - protein, 17 aa, Homo sapiens
  Heavy chain CDR3 for antibody 3892 (IGHV3-33)
AREITVVRGDNYYGLDV

SEQ ID NO: 7785 - protein, 9 aa, Homo sapiens
  Light chain CDR3 for antibody 3893 (IGKV1-16)
QQYNSYPLT

SEQ ID NO: 7786 - protein, 16 aa, Homo sapiens
  Heavy chain CDR3 for antibody 3893 (IGHV3-33)
AREGDSSSWWKDWFDP

SEQ ID NO: 7787 - protein, 9 aa, Homo sapiens
  Light chain CDR3 for antibody 3894 (IGKV1-9)
QQLNGFPYT

SEQ ID NO: 7788 - protein, 15 aa, Homo sapiens
  Heavy chain CDR3 for antibody 3894 (IGHV1-46)
AREKYYGSGSYPFDS

SEQ ID NO: 7789 - protein, 9 aa, Homo sapiens
  Light chain CDR3 for antibody 3895 (IGKV1-17)
QQLNGYPYT

SEQ ID NO: 7790 - protein, 16 aa, Homo sapiens
  Heavy chain CDR3 for antibody 3895 (IGHV1-46)
ARDGNPENYYYYGMDV

SEQ ID NO: 7791 - protein, 9 aa, Homo sapiens
  Light chain CDR3 for antibody 3896 (IGKV1-9)
QQLNGYPYT

SEQ ID NO: 7792 - protein, 15 aa, Homo sapiens
  Heavy chain CDR3 for antibody 3896 (IGHV1-46)
AREKYYGAGSDPFDY

SEQ ID NO: 7793 - protein, 9 aa, Homo sapiens
  Light chain CDR3 for antibody 3897 (IGKV1-9)
QQLNSYPFT

SEQ ID NO: 7794 - protein, 17 aa, Homo sapiens
  Heavy chain CDR3 for antibody 3897 (IGHV3-33)
AREITRARGDNYYGMDA

SEQ ID NO: 7795 - protein, 9 aa, Homo sapiens
  Light chain CDR3 for antibody 3898 (IGKV1-9)
QQLNSYPYT

SEQ ID NO: 7796 - protein, 17 aa, Homo sapiens
  Heavy chain CDR3 for antibody 3898 (IGHV3-33)
ARESTMVRGDNYYGMDV

SEQ ID NO: 7797 - protein, 9 aa, Homo sapiens
  Light chain CDR3 for antibody 3899 (IGKV1-9)
QQLNSYPFT

SEQ ID NO: 7798 - protein, 17 aa, Homo sapiens
  Heavy chain CDR3 for antibody 3899 (IGHV3-33)
VSEITMVRGDNYYGMDA

SEQ ID NO: 7799 - protein, 9 aa, Homo sapiens
  Light chain CDR3 for antibody 3900 (IGKV1D-13)
QQFNNYPYT

SEQ ID NO: 7800 - protein, 17 aa, Homo sapiens
  Heavy chain CDR3 for antibody 3900 (IGHV3-33)
AREITMLRGDNYYGLDV

SEQ ID NO: 7801 - protein, 9 aa, Homo sapiens
  Light chain CDR3 for antibody 3901 (IGKV1-6)
LQDYNYPRT

SEQ ID NO: 7802 - protein, 13 aa, Homo sapiens
  Heavy chain CDR3 for antibody 3901 (IGHV3-33)
ARDRYSGSYPFDY

SEQ ID NO: 7803 - protein, 9 aa, Homo sapiens
  Light chain CDR3 for antibody 3902 (IGKV6-21)
HQSSSLPYT

SEQ ID NO: 7804 - protein, 13 aa, Homo sapiens
  Heavy chain CDR3 for antibody 3902 (IGHV3-33)
ARDYCSGDCYPDP

SEQ ID NO: 7805 - protein, 9 aa, Homo sapiens
  Light chain CDR3 for antibody 3903 (IGKV1-17)
LQHNSYPYT

SEQ ID NO: 7806 - protein, 13 aa, Homo sapiens
  Heavy chain CDR3 for antibody 3903 (IGHV1-46)
ARRDFDWLLDVDY

SEQ ID NO: 7807 - protein, 9 aa, Homo sapiens
  Light chain CDR3 for antibody 3904 (IGKV1D-17)
LQHNSYPYT

SEQ ID NO: 7808 - protein, 6 aa, Homo sapiens
  Heavy chain CDR3 for antibody 3904 (IGHV3-33)
AREIDY

SEQ ID NO: 7809 - protein, 9 aa, Homo sapiens
  Light chain CDR3 for antibody 3905 (IGKV1-9)
QQLNSYPYT

SEQ ID NO: 7810 - protein, 15 aa, Homo sapiens
  Heavy chain CDR3 for antibody 3905 (IGHV1-46)
AREKCDGSGSDPFDY

SEQ ID NO: 7811 - protein, 9 aa, Homo sapiens
  Light chain CDR3 for antibody 3906 (IGKV1-9)
QQFNSHPFT

SEQ ID NO: 7812 - protein, 17 aa, Homo sapiens
  Heavy chain CDR3 for antibody 3906 (IGHV3-33)
AREITMVRGDNSYGLAV

SEQ ID NO: 7813 - protein, 9 aa, Homo sapiens
  Light chain CDR3 for antibody 3907 (IGKV1-9)
QQLNGYPYT

SEQ ID NO: 7814 - protein, 15 aa, Homo sapiens
  Heavy chain CDR3 for antibody 3907 (IGHV1-46)
AREKYYGSGTYPFYS

SEQ ID NO: 7815 - protein, 9 aa, Homo sapiens
  Light chain CDR3 for antibody 3908 (IGKV1-9)
QQLNSYPYT

SEQ ID NO: 7816 - protein, 15 aa, Homo sapiens
  Heavy chain CDR3 for antibody 3908 (IGHV1-46)
AREKYCGSGCYPFDD

SEQ ID NO: 7817 - protein, 9 aa, Homo sapiens
  Light chain CDR3 for antibody 3909 (IGKV1-9)
QQLNGYPYT

SEQ ID NO: 7818 - protein, 15 aa, Homo sapiens
  Heavy chain CDR3 for antibody 3909 (IGHV1-46)
SREKYYGSSSYPFDY

SEQ ID NO: 7819 - protein, 9 aa, Homo sapiens
  Light chain CDR3 for antibody 3910 (IGKV1-9)
QQLNGYPYT

SEQ ID NO: 7820 - protein, 15 aa, Homo sapiens
  Heavy chain CDR3 for antibody 3910 (IGHV1-46)
ARKKYYGSDSYPFDY

SEQ ID NO: 7821 - protein, 9 aa, Homo sapiens
  Light chain CDR3 for antibody 3911 (IGKV1-9)
QQLNSYPYT

SEQ ID NO: 7822 - protein, 15 aa, Homo sapiens
  Heavy chain CDR3 for antibody 3911 (IGHV1-46)
AREKYYGSGSSPIAY

SEQ ID NO: 7823 - protein, 9 aa, Homo sapiens
  Light chain CDR3 for antibody 3912 (IGKV1-9)
QQLNSYPYT

SEQ ID NO: 7824 - protein, 11 aa, Homo sapiens
  Heavy chain CDR3 for antibody 3912 (IGHV3-33)
ARDGYSSGWDY

SEQ ID NO: 7825 - protein, 9 aa, Homo sapiens
  Light chain CDR3 for antibody 3913 (IGKV1-9)
HQLNSYPYT

SEQ ID NO: 7826 - protein, 15 aa, Homo sapiens
  Heavy chain CDR3 for antibody 3913 (IGHV1-46)
AREKSYGSGSYPFDY

SEQ ID NO: 7827 - protein, 9 aa, Homo sapiens
  Light chain CDR3 for antibody 3914 (IGKV1-6)
LQDYNYPRT

SEQ ID NO: 7828 - protein, 11 aa, Homo sapiens
  Heavy chain CDR3 for antibody 3914 (IGHV1-2)
WGTMVRGVPDY

SEQ ID NO: 7829 - protein, 9 aa, Homo sapiens
  Light chain CDR3 for antibody 3915 (IGKV1-9)
QQLNSYPYT

SEQ ID NO: 7830 - protein, 13 aa, Homo sapiens
  Heavy chain CDR3 for antibody 3915 (IGHV3-33)
ARDYGGGDCYIDP

SEQ ID NO: 7831 - protein, 9 aa, Homo sapiens
  Light chain CDR3 for antibody 3916 (IGKV6-21)
QKYNSAPLT

SEQ ID NO: 7832 - protein, 16 aa, Homo sapiens
  Heavy chain CDR3 for antibody 3916 (IGHV1-46)
AREGGSGWDYYYGMDV

SEQ ID NO: 7833 - protein, 9 aa, Homo sapiens
  Light chain CDR3 for antibody 3917 (IGKV1-9)
QQLNSYPYT

SEQ ID NO: 7834 - protein, 11 aa, Homo sapiens
  Heavy chain CDR3 for antibody 3917 (IGHV1-8)
AREGSGSYLGY

SEQ ID NO: 7835 - protein, 9 aa, Homo sapiens
  Light chain CDR3 for antibody 3918 (IGKV1-6)
LQDYNYPRT

SEQ ID NO: 7836 - protein, 10 aa, Homo sapiens
  Heavy chain CDR3 for antibody 3918 (IGHV3-23)
AKEKWELFDI

SEQ ID NO: 7837 - protein, 9 aa, Homo sapiens
  Light chain CDR3 for antibody 3919 (IGKV1D-17)
LQHNSYPYT

SEQ ID NO: 7838 - protein, 15 aa, Homo sapiens
  Heavy chain CDR3 for antibody 3919 (IGHV3-53)
AREKSYGSGSYPFDY

SEQ ID NO: 7839 - protein, 9 aa, Homo sapiens
  Light chain CDR3 for antibody 3920 (IGKV1-9)
QQLNSYPYT

SEQ ID NO: 7840 - protein, 15 aa, Homo sapiens
  Heavy chain CDR3 for antibody 3920 (IGHV1-46)
ARQKYYGSGTYPFAY

SEQ ID NO: 7841 - protein, 9 aa, Homo sapiens
  Light chain CDR3 for antibody 3921 (IGKV1D-17)
LQHNSYPYT

SEQ ID NO: 7842 - protein, 10 aa, Homo sapiens
  Heavy chain CDR3 for antibody 3921 (IGHV3-33)
ARDAVAGFDY

SEQ ID NO: 7843 - protein, 9 aa, Homo sapiens
  Light chain CDR3 for antibody 3922 (IGKV1-9)
QQLNGFPYT

SEQ ID NO: 7844 - protein, 15 aa, Homo sapiens
  Heavy chain CDR3 for antibody 3922 (IGHV1-46)
ARENSYGSGRYPFDY

SEQ ID NO: 7845 - protein, 9 aa, Homo sapiens
  Light chain CDR3 for antibody 3923 (IGKV1-9)
QHLNSYPFT

SEQ ID NO: 7846 - protein, 15 aa, Homo sapiens
  Heavy chain CDR3 for antibody 3923 (IGHV1-46)
AREKYHGSGSYPFDY

SEQ ID NO: 7847 - protein, 9 aa, Homo sapiens
  Light chain CDR3 for antibody 3924 (IGKV1-9)
QQLNSYPFT

SEQ ID NO: 7848 - protein, 18 aa, Homo sapiens
  Heavy chain CDR3 for antibody 3924 (IGHV1-24)
ATDPHYDILTGPYYGMDV

SEQ ID NO: 7849 - protein, 9 aa, Homo sapiens
  Light chain CDR3 for antibody 3925 (IGKV1-9)
QQLNSYPFT

SEQ ID NO: 7850 - protein, 17 aa, Homo sapiens
  Heavy chain CDR3 for antibody 3925 (IGHV3-33)
AREIAMVRGDNYYGLDD

SEQ ID NO: 7851 - protein, 9 aa, Homo sapiens
  Light chain CDR3 for antibody 3926 (IGKV1-9)
QQLNGYPYT

SEQ ID NO: 7852 - protein, 15 aa, Homo sapiens
  Heavy chain CDR3 for antibody 3926 (IGHV1-46)
AIEKFYGSGSSPFDY

SEQ ID NO: 7853 - protein, 9 aa, Homo sapiens
  Light chain CDR3 for antibody 3927 (IGKV1-6)
LQDYNYPRT

SEQ ID NO: 7854 - protein, 16 aa, Homo sapiens
  Heavy chain CDR3 for antibody 3927 (IGHV3-33)
ARAGLLWFGELGWMDV

SEQ ID NO: 7855 - protein, 9 aa, Homo sapiens
  Light chain CDR3 for antibody 3928 (IGKV1-9)
QQLNSYPYT

SEQ ID NO: 7856 - protein, 15 aa, Homo sapiens
  Heavy chain CDR3 for antibody 3928 (IGHV1-46)
AGEKCYGSGSSPFDY

SEQ ID NO: 7857 - protein, 9 aa, Homo sapiens
  Light chain CDR3 for antibody 3929 (IGKV1-9)
QQFNGHPFT

SEQ ID NO: 7858 - protein, 17 aa, Homo sapiens
  Heavy chain CDR3 for antibody 3929 (IGHV3-33)
AREITMVRGDNYYGLDV

SEQ ID NO: 7859 - protein, 9 aa, Homo sapiens
  Light chain CDR3 for antibody 3930 (IGKV1-9)
QQLNGYPYT

SEQ ID NO: 7860 - protein, 15 aa, Homo sapiens
  Heavy chain CDR3 for antibody 3930 (IGHV1-46)
ARENYYGSGSYPFDY

SEQ ID NO: 7861 - protein, 9 aa, Homo sapiens
  Light chain CDR3 for antibody 3931 (IGKV1-9)
QQLNGYPYT

SEQ ID NO: 7862 - protein, 15 aa, Homo sapiens
  Heavy chain CDR3 for antibody 3931 (IGHV1-46)
AREKYYGSGSYPFNY

SEQ ID NO: 7863 - protein, 9 aa, Homo sapiens
  Light chain CDR3 for antibody 3932 (IGKV1-9)
QQLNSYPFT

SEQ ID NO: 7864 - protein, 17 aa, Homo sapiens
  Heavy chain CDR3 for antibody 3932 (IGHV3-33)
AREITMLRGDNSYGMDV

SEQ ID NO: 7865 - protein, 9 aa, Homo sapiens
  Light chain CDR3 for antibody 3933 (IGKV1-9)
QQLNSYPYT

SEQ ID NO: 7866 - protein, 15 aa, Homo sapiens
  Heavy chain CDR3 for antibody 3933 (IGHV1-46)
ARENYYGSGTYPFDY

SEQ ID NO: 7867 - protein, 9 aa, Homo sapiens
  Light chain CDR3 for antibody 3934 (IGKV6-21)
QKYGSSPLT

SEQ ID NO: 7868 - protein, 15 aa, Homo sapiens
  Heavy chain CDR3 for antibody 3934 (IGHV1-24)
ATGYYGSGSSEYFQH

SEQ ID NO: 7869 - protein, 9 aa, Homo sapiens
  Light chain CDR3 for antibody 3935 (IGKV1-9)
QQFNSHPFT

SEQ ID NO: 7870 - protein, 17 aa, Homo sapiens
  Heavy chain CDR3 for antibody 3935 (IGHV3-33)
AREITMVRGDNYYGMDA

SEQ ID NO: 7871 - protein, 9 aa, Homo sapiens
  Light chain CDR3 for antibody 3936 (IGKV1D-17)
QQLNSYPYT

SEQ ID NO: 7872 - protein, 17 aa, Homo sapiens
  Heavy chain CDR3 for antibody 3936 (IGHV3-33)
AREITMVRVDNYYGMAV

SEQ ID NO: 7873 - protein, 8 aa, Homo sapiens
  Light chain CDR3 for antibody 3937 (IGKV3D-20)
QQYGSSWT

SEQ ID NO: 7874 - protein, 10 aa, Homo sapiens
  Heavy chain CDR3 for antibody 3937 (IGHV3-33)
ARESTDGMDV

SEQ ID NO: 7875 - protein, 9 aa, Homo sapiens
  Light chain CDR3 for antibody 3938 (IGKV1-6)
LQDYNYPYT

SEQ ID NO: 7876 - protein, 11 aa, Homo sapiens
  Heavy chain CDR3 for antibody 3938 (IGHV3-20)
ARDQGIAAADY

SEQ ID NO: 7877 - protein, 9 aa, Homo sapiens
  Light chain CDR3 for antibody 3939 (IGKV1-9)
QQFNSHPFT

SEQ ID NO: 7878 - protein, 16 aa, Homo sapiens
  Heavy chain CDR3 for antibody 3939 (IGHV1-18)
AREGDTMVRGVIAFDY

SEQ ID NO: 7879 - protein, 9 aa, Homo sapiens
  Light chain CDR3 for antibody 3940 (IGKV1-9)
QQLNGYPYT

SEQ ID NO: 7880 - protein, 15 aa, Homo sapiens
  Heavy chain CDR3 for antibody 3940 (IGHV1-46)
AGEKCDGSGSYPFDY

SEQ ID NO: 7881 - protein, 9 aa, Homo sapiens
  Light chain CDR3 for antibody 3941 (IGKV1D-17)
LQHNSYPYT

SEQ ID NO: 7882 - protein, 10 aa, Homo sapiens
  Heavy chain CDR3 for antibody 3941 (IGHV3-33)
AREAGAGFDY

SEQ ID NO: 7883 - protein, 9 aa, Homo sapiens
  Light chain CDR3 for antibody 3942 (IGKV1-17)
LQHNSYPRT

SEQ ID NO: 7884 - protein, 18 aa, Homo sapiens
  Heavy chain CDR3 for antibody 3942 (IGHV3-23)
AKEEEQQLVYYYYYGMDV

SEQ ID NO: 7885 - protein, 9 aa, Homo sapiens
  Light chain CDR3 for antibody 3943 (IGKV1-9)
QQLNSYPYT

SEQ ID NO: 7886 - protein, 15 aa, Homo sapiens
  Heavy chain CDR3 for antibody 3943 (IGHV1-46)
ARENFYGSGSYPFDY

SEQ ID NO: 7887 - protein, 9 aa, Homo sapiens
  Light chain CDR3 for antibody 3944 (IGKV1-6)
LQDYNYPYT

SEQ ID NO: 7888 - protein, 12 aa, Homo sapiens
  Heavy chain CDR3 for antibody 3944 (IGHV1-18)
ARDRAAAAPLGY

SEQ ID NO: 7889 - protein, 9 aa, Homo sapiens
  Light chain CDR3 for antibody 3945 (IGKV1-9)
QQLNSYPYT

SEQ ID NO: 7890 - protein, 15 aa, Homo sapiens
  Heavy chain CDR3 for antibody 3945 (IGHV1-46)
ARKKYYGSGNYPFDY

SEQ ID NO: 7891 - protein, 9 aa, Homo sapiens
  Light chain CDR3 for antibody 3946 (IGKV1-9)
QQLNSYPYT

SEQ ID NO: 7892 - protein, 15 aa, Homo sapiens
  Heavy chain CDR3 for antibody 3946 (IGHV1-46)
AREKVCGAGSYPFDY

SEQ ID NO: 7893 - protein, 9 aa, Homo sapiens
  Light chain CDR3 for antibody 3947 (IGKV1-9)
QQLNSYPYT

SEQ ID NO: 7894 - protein, 15 aa, Homo sapiens
  Heavy chain CDR3 for antibody 3947 (IGHV1-46)
ARDKYHGSGNYPFDY

SEQ ID NO: 7895 - protein, 8 aa, Homo sapiens
  Light chain CDR3 for antibody 3948 (IGKV3D-20)
QQYGSSWT

SEQ ID NO: 7896 - protein, 10 aa, Homo sapiens
  Heavy chain CDR3 for antibody 3948 (IGHV3-33)
ARESVAGFDY

SEQ ID NO: 7897 - protein, 9 aa, Homo sapiens
  Light chain CDR3 for antibody 3949 (IGKV3D-20)
QQYGSSPYT

SEQ ID NO: 7898 - protein, 15 aa, Homo sapiens
  Heavy chain CDR3 for antibody 3949 (IGHV1-46)
AREKYYGSGSYPFDY

SEQ ID NO: 7899 - protein, 9 aa, Homo sapiens
  Light chain CDR3 for antibody 3950 (IGKV1D-17)
LQHNSYPYT

SEQ ID NO: 7900 - protein, 14 aa, Homo sapiens
  Heavy chain CDR3 for antibody 3950 (IGHV3-33)
ARGARYFDYYGMDV

SEQ ID NO: 7901 - protein, 9 aa, Homo sapiens
  Light chain CDR3 for antibody 3951 (IGKV1-17)
LQHNSYPFT

SEQ ID NO: 7902 - protein, 7 aa, Homo sapiens
  Heavy chain CDR3 for antibody 3951 (IGHV3-33)
ARDPTDY

SEQ ID NO: 7903 - protein, 9 aa, Homo sapiens
  Light chain CDR3 for antibody 3952 (IGKV1D-17)
LQHNSYPWT

SEQ ID NO: 7904 - protein, 10 aa, Homo sapiens
  Heavy chain CDR3 for antibody 3952 (IGHV3-33)
ARESRSGVDY

SEQ ID NO: 7905 - protein, 9 aa, Homo sapiens
  Light chain CDR3 for antibody 3953 (IGKV1-9)
QHLNSHPFT

SEQ ID NO: 7906 - protein, 17 aa, Homo sapiens
  Heavy chain CDR3 for antibody 3953 (IGHV3-33)
ARESTRVRGDNYYGMDV

SEQ ID NO: 7907 - protein, 9 aa, Homo sapiens
  Light chain CDR3 for antibody 3954 (IGKV1-9)
QQLNSYPFT

SEQ ID NO: 7908 - protein, 17 aa, Homo sapiens
  Heavy chain CDR3 for antibody 3954 (IGHV3-33)
AREITMVRRDNYYGIDF

SEQ ID NO: 7909 - protein, 9 aa, Homo sapiens
  Light chain CDR3 for antibody 3955 (IGKV1-9)
QQLNSYPFT

SEQ ID NO: 7910 - protein, 17 aa, Homo sapiens
  Heavy chain CDR3 for antibody 3955 (IGHV3-33)
EREINRVRGENYYGMDV

SEQ ID NO: 7911 - protein, 9 aa, Homo sapiens
  Light chain CDR3 for antibody 3956 (IGKV1-9)
QQLNSYPFT

SEQ ID NO: 7912 - protein, 17 aa, Homo sapiens
  Heavy chain CDR3 for antibody 3956 (IGHV3-33)
EREITLVRGDNYYGIDV

SEQ ID NO: 7913 - protein, 9 aa, Homo sapiens
  Light chain CDR3 for antibody 3957 (IGKV1-9)
QQLNGYPYT

SEQ ID NO: 7914 - protein, 17 aa, Homo sapiens
  Heavy chain CDR3 for antibody 3957 (IGHV3-11)
AREITMVRGDNYYGFDY

SEQ ID NO: 7915 - protein, 9 aa, Homo sapiens
  Light chain CDR3 for antibody 3958 (IGKV1-9)
QQLNGFPYT

SEQ ID NO: 7916 - protein, 15 aa, Homo sapiens
  Heavy chain CDR3 for antibody 3958 (IGHV1-46)
AREKYQGSGSYAIDY

SEQ ID NO: 7917 - protein, 9 aa, Homo sapiens
  Light chain CDR3 for antibody 3959 (IGKV1-9)
QQLNSYPFT

SEQ ID NO: 7918 - protein, 16 aa, Homo sapiens
  Heavy chain CDR3 for antibody 3959 (IGHV3-33)
ARDRDIVATGEYYFDY

SEQ ID NO: 7919 - protein, 9 aa, Homo sapiens
  Light chain CDR3 for antibody 3960 (IGKV1D-17)
LQHNSYPYT

SEQ ID NO: 7920 - protein, 17 aa, Homo sapiens
  Heavy chain CDR3 for antibody 3960 (IGHV3-33)
VREISLVRGDNYYGLDV

SEQ ID NO: 7921 - protein, 9 aa, Homo sapiens
  Light chain CDR3 for antibody 3961 (IGKV1-9)
QQLNGYPYT

SEQ ID NO: 7922 - protein, 15 aa, Homo sapiens
  Heavy chain CDR3 for antibody 3961 (IGHV1-46)
AREKYYGSGSYAMDF

SEQ ID NO: 7923 - protein, 9 aa, Homo sapiens
  Light chain CDR3 for antibody 3962 (IGKV1-9)
QQFNSHPFT

SEQ ID NO: 7924 - protein, 17 aa, Homo sapiens
  Heavy chain CDR3 for antibody 3962 (IGHV3-33)
ARESNMCRGDNYYGLDV

SEQ ID NO: 7925 - protein, 9 aa, Homo sapiens
  Light chain CDR3 for antibody 3963 (IGKV1D-17)
LQHNSYPYT

SEQ ID NO: 7926 - protein, 13 aa, Homo sapiens
  Heavy chain CDR3 for antibody 3963 (IGHV1-18)
AREGGSFYVSFDY

SEQ ID NO: 7927 - protein, 9 aa, Homo sapiens
  Light chain CDR3 for antibody 3964 (IGKV1-9)
QQLNSYPFT

SEQ ID NO: 7928 - protein, 16 aa, Homo sapiens
  Heavy chain CDR3 for antibody 3964 (IGHV3-33)
ARFGYSYGYDYCGMDV

SEQ ID NO: 7929 - protein, 9 aa, Homo sapiens
  Light chain CDR3 for antibody 3965 (IGKV1-9)
QQLNSYPYT

SEQ ID NO: 7930 - protein, 13 aa, Homo sapiens
  Heavy chain CDR3 for antibody 3965 (IGHV1-46)
AREGGNYYVSFDH

SEQ ID NO: 7931 - protein, 9 aa, Homo sapiens
  Light chain CDR3 for antibody 3966 (IGKV1-9)
QQLNSYPFT

SEQ ID NO: 7932 - protein, 15 aa, Homo sapiens
  Heavy chain CDR3 for antibody 3966 (IGHV3-33)
AREITMVRGVIAFDY

SEQ ID NO: 7933 - protein, 9 aa, Homo sapiens
  Light chain CDR3 for antibody 3967 (IGKV1-9)
QQLNSYPYT

SEQ ID NO: 7934 - protein, 15 aa, Homo sapiens
  Heavy chain CDR3 for antibody 3967 (IGHV1-46)
AREKCYGSGSYAIDY

SEQ ID NO: 7935 - protein, 9 aa, Homo sapiens
  Light chain CDR3 for antibody 3968 (IGKV1-9)
QQLNSYPYT

SEQ ID NO: 7936 - protein, 15 aa, Homo sapiens
  Heavy chain CDR3 for antibody 3968 (IGHV1-46)
AREKYYGSGSYPIDD

SEQ ID NO: 7937 - protein, 9 aa, Homo sapiens
  Light chain CDR3 for antibody 3969 (IGKV1-9)
QQLNSYPYT

SEQ ID NO: 7938 - protein, 17 aa, Homo sapiens
  Heavy chain CDR3 for antibody 3969 (IGHV3-48)
AREITMVRGDTSYGLDV

SEQ ID NO: 7939 - protein, 9 aa, Homo sapiens
  Light chain CDR3 for antibody 3970 (IGKV1-9)
QHLNSHPFT

SEQ ID NO: 7940 - protein, 15 aa, Homo sapiens
  Heavy chain CDR3 for antibody 3970 (IGHV1-46)
AREKYYGSGSYPFDY

SEQ ID NO: 7941 - protein, 9 aa, Homo sapiens
  Light chain CDR3 for antibody 3971 (IGKV1D-17)
LQHNSYPYT

SEQ ID NO: 7942 - protein, 16 aa, Homo sapiens
  Heavy chain CDR3 for antibody 3971 (IGHV1-18)
AREGDTMVRGVIAFDY

SEQ ID NO: 7943 - protein, 9 aa, Homo sapiens
  Light chain CDR3 for antibody 3972 (IGKV1-6)
QQLNSYPYT

SEQ ID NO: 7944 - protein, 13 aa, Homo sapiens
  Heavy chain CDR3 for antibody 3972 (IGHV3-23)
ARDYCGGDYYLDP

SEQ ID NO: 7945 - protein, 9 aa, Homo sapiens
  Light chain CDR3 for antibody 3973 (IGKV1D-17)
LQHNSYPYT

SEQ ID NO: 7946 - protein, 10 aa, Homo sapiens
  Heavy chain CDR3 for antibody 3973 (IGHV3-33)
AREAVDGFDY

SEQ ID NO: 7947 - protein, 9 aa, Homo sapiens
  Light chain CDR3 for antibody 3974 (IGKV6-21)
HQSSILPYT

SEQ ID NO: 7948 - protein, 17 aa, Homo sapiens
  Heavy chain CDR3 for antibody 3974 (IGHV1-18)
AREGRITMVRGVIAFDY

SEQ ID NO: 7949 - protein, 9 aa, Homo sapiens
  Light chain CDR3 for antibody 3975 (IGKV1-9)
QQLNSYPYT

SEQ ID NO: 7950 - protein, 17 aa, Homo sapiens
  Heavy chain CDR3 for antibody 3975 (IGHV3-33)
AREITMVRGYNYYGFDV

SEQ ID NO: 7951 - protein, 9 aa, Homo sapiens
  Light chain CDR3 for antibody 3976 (IGKV1-9)
HQLISYPYT

SEQ ID NO: 7952 - protein, 15 aa, Homo sapiens
  Heavy chain CDR3 for antibody 3976 (IGHV1-46)
AREKYYGSGSSPFDY

SEQ ID NO: 7953 - protein, 9 aa, Homo sapiens
  Light chain CDR3 for antibody 3977 (IGKV1-9)
QQFNSYPFT

SEQ ID NO: 7954 - protein, 17 aa, Homo sapiens
  Heavy chain CDR3 for antibody 3977 (IGHV3-33)
AREITMRRGDNYDGLDV

SEQ ID NO: 7955 - protein, 9 aa, Homo sapiens
  Light chain CDR3 for antibody 3978 (IGKV1-9)
QQLNGYPLT

SEQ ID NO: 7956 - protein, 16 aa, Homo sapiens
  Heavy chain CDR3 for antibody 3978 (IGHV1-2)
AREGDTMVRGVIAFDY

SEQ ID NO: 7957 - protein, 9 aa, Homo sapiens
  Light chain CDR3 for antibody 3979 (IGKV1-9)
QQLNSYPYT

SEQ ID NO: 7958 - protein, 15 aa, Homo sapiens
  Heavy chain CDR3 for antibody 3979 (IGHV1-46)
AREKYYGAESYPIDY

SEQ ID NO: 7959 - protein, 9 aa, Homo sapiens
  Light chain CDR3 for antibody 3980 (IGKV1-9)
QQLNSYPFT

SEQ ID NO: 7960 - protein, 17 aa, Homo sapiens
  Heavy chain CDR3 for antibody 3980 (IGHV3-33)
ARESTMLRGENYYGLDV

SEQ ID NO: 7961 - protein, 9 aa, Homo sapiens
  Light chain CDR3 for antibody 3981 (IGKV1-27)
QKYNSAPPT

SEQ ID NO: 7962 - protein, 17 aa, Homo sapiens
  Heavy chain CDR3 for antibody 3981 (IGHV3-33)
ARDRYYGSGSYYIPSDY

SEQ ID NO: 7963 - protein, 9 aa, Homo sapiens
  Light chain CDR3 for antibody 3982 (IGKV1-9)
QQLNSYPYT

SEQ ID NO: 7964 - protein, 15 aa, Homo sapiens
  Heavy chain CDR3 for antibody 3982 (IGHV1-46)
AREKYYGSGNYAMDY

SEQ ID NO: 7965 - protein, 9 aa, Homo sapiens
  Light chain CDR3 for antibody 3983 (IGKV1-9)
QQLNGFPYT

SEQ ID NO: 7966 - protein, 15 aa, Homo sapiens
  Heavy chain CDR3 for antibody 3983 (IGHV1-46)
AREKDYGSGIYPFDY

SEQ ID NO: 7967 - protein, 9 aa, Homo sapiens
  Light chain CDR3 for antibody 3984 (IGKV1-9)
QQLNSYPYT

SEQ ID NO: 7968 - protein, 10 aa, Homo sapiens
  Heavy chain CDR3 for antibody 3984 (IGHV1-46)
ARESVSGFDY

SEQ ID NO: 7969 - protein, 9 aa, Homo sapiens
  Light chain CDR3 for antibody 3985 (IGKV1-9)
QQLNSYPLT

SEQ ID NO: 7970 - protein, 15 aa, Homo sapiens
  Heavy chain CDR3 for antibody 3985 (IGHV1-24)
ATAPIPMVRGVFFDY

SEQ ID NO: 7971 - protein, 9 aa, Homo sapiens
  Light chain CDR3 for antibody 3986 (IGKV1-9)
QQLISYPYT

SEQ ID NO: 7972 - protein, 15 aa, Homo sapiens
  Heavy chain CDR3 for antibody 3986 (IGHV1-46)
AREKYYVSGTYPFDS

SEQ ID NO: 7973 - protein, 9 aa, Homo sapiens
  Light chain CDR3 for antibody 3987 (IGKV1-9)
QQLDSHPFT

SEQ ID NO: 7974 - protein, 15 aa, Homo sapiens
  Heavy chain CDR3 for antibody 3987 (IGHV1-46)
AREKYYGSASYPFDY

SEQ ID NO: 7975 - protein, 9 aa, Homo sapiens
  Light chain CDR3 for antibody 3988 (IGKV1-8)
QQYYSYPRT

SEQ ID NO: 7976 - protein, 10 aa, Homo sapiens
  Heavy chain CDR3 for antibody 3988 (IGHV3-33)
AREGYSGYDY

SEQ ID NO: 7977 - protein, 9 aa, Homo sapiens
  Light chain CDR3 for antibody 3989 (IGKV1-17)
LQHNSYPLT

SEQ ID NO: 7978 - protein, 10 aa, Homo sapiens
  Heavy chain CDR3 for antibody 3989 (IGHV3-23)
AKGGLWFGEY

SEQ ID NO: 7979 - protein, 9 aa, Homo sapiens
  Light chain CDR3 for antibody 3990 (IGKV1-9)
QQLNSYPYT

SEQ ID NO: 7980 - protein, 15 aa, Homo sapiens
  Heavy chain CDR3 for antibody 3990 (IGHV1-46)
ARENYYSSESYPFDY

SEQ ID NO: 7981 - protein, 9 aa, Homo sapiens
  Light chain CDR3 for antibody 3991 (IGKV1-9)
QQLNGFPYT

SEQ ID NO: 7982 - protein, 15 aa, Homo sapiens
  Heavy chain CDR3 for antibody 3991 (IGHV1-46)
AREKYYGSGSYAFEY

SEQ ID NO: 7983 - protein, 9 aa, Homo sapiens
  Light chain CDR3 for antibody 3992 (IGKV1-5)
QQYNSYSRT

SEQ ID NO: 7984 - protein, 15 aa, Homo sapiens
  Heavy chain CDR3 for antibody 3992 (IGHV1-46)
AREKYYGSGSYPFDY

SEQ ID NO: 7985 - protein, 9 aa, Homo sapiens
  Light chain CDR3 for antibody 3993 (IGKV1-9)
QQLNSYPFT

SEQ ID NO: 7986 - protein, 17 aa, Homo sapiens
  Heavy chain CDR3 for antibody 3993 (IGHV3-33)
AREITMFRGDNYYGIDV

SEQ ID NO: 7987 - protein, 9 aa, Homo sapiens
  Light chain CDR3 for antibody 3994 (IGKV1-9)
QQFNSHPFT

SEQ ID NO: 7988 - protein, 17 aa, Homo sapiens
  Heavy chain CDR3 for antibody 3994 (IGHV3-23)
ERESTMYRGDNYYGLDV

SEQ ID NO: 7989 - protein, 9 aa, Homo sapiens
  Light chain CDR3 for antibody 3995 (IGKV1-9)
QQLNSYPLT

SEQ ID NO: 7990 - protein, 15 aa, Homo sapiens
  Heavy chain CDR3 for antibody 3995 (IGHV1-46)
AREKYYGSGTYPFDS

SEQ ID NO: 7991 - protein, 9 aa, Homo sapiens
  Light chain CDR3 for antibody 3996 (IGKV1-9)
QQLNSYPLT

SEQ ID NO: 7992 - protein, 15 aa, Homo sapiens
  Heavy chain CDR3 for antibody 3996 (IGHV1-46)
ARQKYYGSASYPFDY

SEQ ID NO: 7993 - protein, 9 aa, Homo sapiens
  Light chain CDR3 for antibody 3997 (IGKV1-9)
QQFNSHPFT

SEQ ID NO: 7994 - protein, 17 aa, Homo sapiens
  Heavy chain CDR3 for antibody 3997 (IGHV3-33)
AREITMVRGENYYGMDV

SEQ ID NO: 7995 - protein, 9 aa, Homo sapiens
  Light chain CDR3 for antibody 3998 (IGKV1-9)
QQLNSYPYT

SEQ ID NO: 7996 - protein, 15 aa, Homo sapiens
  Heavy chain CDR3 for antibody 3998 (IGHV1-46)
AREKSYGSGSYPIDY

SEQ ID NO: 7997 - protein, 9 aa, Homo sapiens
  Light chain CDR3 for antibody 3999 (IGKV1-9)
QQLNGFPYT

SEQ ID NO: 7998 - protein, 10 aa, Homo sapiens
  Heavy chain CDR3 for antibody 3999 (IGHV3-33)
AREGRTGFDY

SEQ ID NO: 7999 - protein, 8 aa, Homo sapiens
  Light chain CDR3 for antibody 4000 (IGKV3D-20)
QQYGSSWT

SEQ ID NO: 8000 - protein, 15 aa, Homo sapiens
  Heavy chain CDR3 for antibody 4000 (IGHV1-46)
AREKYYGSGSYPFDY

SEQ ID NO: 8001 - protein, 9 aa, Homo sapiens
  Light chain CDR3 for antibody 4001 (IGKV6-21)
HQSSSLPYT

SEQ ID NO: 8002 - protein, 16 aa, Homo sapiens
  Heavy chain CDR3 for antibody 4001 (IGHV1-18)
ATEGAVAGYYYYGMDV

SEQ ID NO: 8003 - protein, 9 aa, Homo sapiens
  Light chain CDR3 for antibody 4002 (IGKV1-5)
QQYNSYSRT

SEQ ID NO: 8004 - protein, 17 aa, Homo sapiens
  Heavy chain CDR3 for antibody 4002 (IGHV3-33)
AREITMVRGDNYYGMDV

SEQ ID NO: 8005 - protein, 9 aa, Homo sapiens
  Light chain CDR3 for antibody 4003 (IGKV1-9)
QQLNGFPYT

SEQ ID NO: 8006 - protein, 17 aa, Homo sapiens
  Heavy chain CDR3 for antibody 4003 (IGHV3-33)
AREITRLRGDNYYGLDV

SEQ ID NO: 8007 - protein, 9 aa, Homo sapiens
  Light chain CDR3 for antibody 4004 (IGKV1-9)
QQFNSYPFT

SEQ ID NO: 8008 - protein, 17 aa, Homo sapiens
  Heavy chain CDR3 for antibody 4004 (IGHV3-48)
AREITIVRGDKYYGIDV

SEQ ID NO: 8009 - protein, 9 aa, Homo sapiens
  Light chain CDR3 for antibody 4005 (IGKV1-9)
QQFNSHPFT

SEQ ID NO: 8010 - protein, 17 aa, Homo sapiens
  Heavy chain CDR3 for antibody 4005 (IGHV3-33)
ERESTMVRGDNYYGMDD

SEQ ID NO: 8011 - protein, 9 aa, Homo sapiens
  Light chain CDR3 for antibody 4006 (IGKV1D-17)
LQHNSYPYT

SEQ ID NO: 8012 - protein, 9 aa, Homo sapiens
  Heavy chain CDR3 for antibody 4006 (IGHV3-23)
AKEAVAGDY

SEQ ID NO: 8013 - protein, 9 aa, Homo sapiens
  Light chain CDR3 for antibody 4007 (IGKV3D-20)
QQYGSSPYT

SEQ ID NO: 8014 - protein, 17 aa, Homo sapiens
  Heavy chain CDR3 for antibody 4007 (IGHV3-33)
AREITMVRGDNYYGLDV

SEQ ID NO: 8015 - protein, 9 aa, Homo sapiens
  Light chain CDR3 for antibody 4008 (IGKV1-9)
QQLNSYPFT

SEQ ID NO: 8016 - protein, 17 aa, Homo sapiens
  Heavy chain CDR3 for antibody 4008 (IGHV3-33)
AREIPLARGDNYYGMDV

SEQ ID NO: 8017 - protein, 9 aa, Homo sapiens
  Light chain CDR3 for antibody 4009 (IGKV1-9)
HQLISYPYT

SEQ ID NO: 8018 - protein, 15 aa, Homo sapiens
  Heavy chain CDR3 for antibody 4009 (IGHV1-46)
AREGLTGYYPNWFDP

SEQ ID NO: 8019 - protein, 9 aa, Homo sapiens
  Light chain CDR3 for antibody 4010 (IGKV1-9)
QQFNSYPFT

SEQ ID NO: 8020 - protein, 17 aa, Homo sapiens
  Heavy chain CDR3 for antibody 4010 (IGHV3-33)
GRESTMGRGDNYYGMDV

SEQ ID NO: 8021 - protein, 9 aa, Homo sapiens
  Light chain CDR3 for antibody 4011 (IGKV1-17)
LQHNTYPRT

SEQ ID NO: 8022 - protein, 15 aa, Homo sapiens
  Heavy chain CDR3 for antibody 4011 (IGHV1-46)
AREKYYGSGSYPFDY

SEQ ID NO: 8023 - protein, 8 aa, Homo sapiens
  Light chain CDR3 for antibody 4012 (IGKV3D-20)
QQYGSSWT

SEQ ID NO: 8024 - protein, 17 aa, Homo sapiens
  Heavy chain CDR3 for antibody 4012 (IGHV3-33)
AREITMVRGDNYYGMDV

SEQ ID NO: 8025 - protein, 9 aa, Homo sapiens
  Light chain CDR3 for antibody 4013 (IGKV1-9)
QQLNSYPFT

SEQ ID NO: 8026 - protein, 17 aa, Homo sapiens
  Heavy chain CDR3 for antibody 4013 (IGHV3-33)
EREITRVRGDDYYGMDV

SEQ ID NO: 8027 - protein, 9 aa, Homo sapiens
  Light chain CDR3 for antibody 4014 (IGKV1-9)
QQLNGYPYT

SEQ ID NO: 8028 - protein, 15 aa, Homo sapiens
  Heavy chain CDR3 for antibody 4014 (IGHV1-46)
SREKYYVSATYPFDY

SEQ ID NO: 8029 - protein, 9 aa, Homo sapiens
  Light chain CDR3 for antibody 4015 (IGKV1D-8)
QQYYSFPRT

SEQ ID NO: 8030 - protein, 16 aa, Homo sapiens
  Heavy chain CDR3 for antibody 4015 (IGHV1-46)
AREGDTMVRGVIAFDY

SEQ ID NO: 8031 - protein, 9 aa, Homo sapiens
  Light chain CDR3 for antibody 4016 (IGKV1-9)
QQLNSYPYT

SEQ ID NO: 8032 - protein, 15 aa, Homo sapiens
  Heavy chain CDR3 for antibody 4016 (IGHV1-46)
AREKYDGAGTYPIDY

SEQ ID NO: 8033 - protein, 9 aa, Homo sapiens
  Light chain CDR3 for antibody 4017 (IGKV1-9)
HQLNIYPYT

SEQ ID NO: 8034 - protein, 15 aa, Homo sapiens
  Heavy chain CDR3 for antibody 4017 (IGHV1-46)
AREKYYGSGSYPFDD

SEQ ID NO: 8035 - protein, 9 aa, Homo sapiens
  Light chain CDR3 for antibody 4018 (IGKV1-27)
QKYNSAPFT

SEQ ID NO: 8036 - protein, 17 aa, Homo sapiens
  Heavy chain CDR3 for antibody 4018 (IGHV1-46)
AREITMVRGDNYYGMDV

SEQ ID NO: 8037 - protein, 9 aa, Homo sapiens
  Light chain CDR3 for antibody 4019 (IGKV1-9)
QQLNGYPYT

SEQ ID NO: 8038 - protein, 17 aa, Homo sapiens
  Heavy chain CDR3 for antibody 4019 (IGHV3-33)
AREITMVRGDNSYGMDA

SEQ ID NO: 8039 - protein, 9 aa, Homo sapiens
  Light chain CDR3 for antibody 4020 (IGKV3D-20)
QQYGSSPYT

SEQ ID NO: 8040 - protein, 10 aa, Homo sapiens
  Heavy chain CDR3 for antibody 4020 (IGHV3-33)
ARESVAGFDY

SEQ ID NO: 8041 - protein, 9 aa, Homo sapiens
  Light chain CDR3 for antibody 4021 (IGKV1-9)
QQFNSYPFT

SEQ ID NO: 8042 - protein, 17 aa, Homo sapiens
  Heavy chain CDR3 for antibody 4021 (IGHV3-64)
GREITMFRGDNYYGIDV

SEQ ID NO: 8043 - protein, 9 aa, Homo sapiens
  Light chain CDR3 for antibody 4022 (IGKV1-9)
QQLNSYPYT

SEQ ID NO: 8044 - protein, 17 aa, Homo sapiens
  Heavy chain CDR3 for antibody 4022 (IGHV3-33)
AGEITMVRGDNYDGMDV

SEQ ID NO: 8045 - protein, 9 aa, Homo sapiens
  Light chain CDR3 for antibody 4023 (IGKV1-9)
QQLNSYPYT

SEQ ID NO: 8046 - protein, 15 aa, Homo sapiens
  Heavy chain CDR3 for antibody 4023 (IGHV1-46)
AREKFSGSGTYPFDS

SEQ ID NO: 8047 - protein, 9 aa, Homo sapiens
  Light chain CDR3 for antibody 4024 (IGKV6-21)
HQSSSLPYT

SEQ ID NO: 8048 - protein, 13 aa, Homo sapiens
  Heavy chain CDR3 for antibody 4024 (IGHV1-18)
AREGGRYYVSFDY

SEQ ID NO: 8049 - protein, 9 aa, Homo sapiens
  Light chain CDR3 for antibody 4025 (IGKV1-17)
LQHNSYPRT

SEQ ID NO: 8050 - protein, 9 aa, Homo sapiens
  Heavy chain CDR3 for antibody 4025 (IGHV3-33)
ARDDGYFDY

SEQ ID NO: 8051 - protein, 9 aa, Homo sapiens
  Light chain CDR3 for antibody 4026 (IGKV1-9)
QQLNSYPYT

SEQ ID NO: 8052 - protein, 15 aa, Homo sapiens
  Heavy chain CDR3 for antibody 4026 (IGHV1-46)
AIDKYYGSGSYPFDY

SEQ ID NO: 8053 - protein, 9 aa, Homo sapiens
  Light chain CDR3 for antibody 4027 (IGKV1-9)
QQLNGFPYT

SEQ ID NO: 8054 - protein, 15 aa, Homo sapiens
  Heavy chain CDR3 for antibody 4027 (IGHV1-46)
AREKSYGSGSSPFDY

SEQ ID NO: 8055 - protein, 9 aa, Homo sapiens
  Light chain CDR3 for antibody 4028 (IGKV1-9)
QQLNSYPYT

SEQ ID NO: 8056 - protein, 17 aa, Homo sapiens
  Heavy chain CDR3 for antibody 4028 (IGHV3-33)
ARDLAYCGGDCYSPFDY

SEQ ID NO: 8057 - protein, 9 aa, Homo sapiens
  Light chain CDR3 for antibody 4029 (IGKV1-9)
QQLNSYPYT

SEQ ID NO: 8058 - protein, 6 aa, Homo sapiens
  Heavy chain CDR3 for antibody 4029 (IGHV3-33)
ASEIDY

SEQ ID NO: 8059 - protein, 9 aa, Homo sapiens
  Light chain CDR3 for antibody 4030 (IGKV1-9)
QQLNSYPYT

SEQ ID NO: 8060 - protein, 15 aa, Homo sapiens
  Heavy chain CDR3 for antibody 4030 (IGHV1-46)
AGEKYDGSGSYPFDY

SEQ ID NO: 8061 - protein, 9 aa, Homo sapiens
  Light chain CDR3 for antibody 4031 (IGKV1-9)
QQLNSYPFT

SEQ ID NO: 8062 - protein, 17 aa, Homo sapiens
  Heavy chain CDR3 for antibody 4031 (IGHV3-33)
AREITMVRGDNYYAIDV

SEQ ID NO: 8063 - protein, 9 aa, Homo sapiens
  Light chain CDR3 for antibody 4032 (IGKV1-9)
QQLNGFPYT

SEQ ID NO: 8064 - protein, 15 aa, Homo sapiens
  Heavy chain CDR3 for antibody 4032 (IGHV1-46)
ARENYYGSGSDPFDY

SEQ ID NO: 8065 - protein, 9 aa, Homo sapiens
  Light chain CDR3 for antibody 4033 (IGKV1-9)
QQLNSYPFT

SEQ ID NO: 8066 - protein, 17 aa, Homo sapiens
  Heavy chain CDR3 for antibody 4033 (IGHV3-33)
AREITMVRGDDYYGLDV

SEQ ID NO: 8067 - protein, 9 aa, Homo sapiens
  Light chain CDR3 for antibody 4034 (IGKV1-9)
QQLNSYPYT

SEQ ID NO: 8068 - protein, 13 aa, Homo sapiens
  Heavy chain CDR3 for antibody 4034 (IGHV3-33)
ARDYGSGDYYSDP

SEQ ID NO: 8069 - protein, 9 aa, Homo sapiens
  Light chain CDR3 for antibody 4035 (IGKV6-21)
HQSSSLPYT

SEQ ID NO: 8070 - protein, 13 aa, Homo sapiens
  Heavy chain CDR3 for antibody 4035 (IGHV1-18)
AREGGSDYVSLDY

SEQ ID NO: 8071 - protein, 9 aa, Homo sapiens
  Light chain CDR3 for antibody 4036 (IGKV1-9)
HQLNSYPYT

SEQ ID NO: 8072 - protein, 17 aa, Homo sapiens
  Heavy chain CDR3 for antibody 4036 (IGHV3-33)
GREITMVRGENYYGMDV

SEQ ID NO: 8073 - protein, 9 aa, Homo sapiens
  Light chain CDR3 for antibody 4037 (IGKV1-9)
QQLDSYPYT

SEQ ID NO: 8074 - protein, 17 aa, Homo sapiens
  Heavy chain CDR3 for antibody 4037 (IGHV3-33)
AREITMVRGDNHYGMDV

SEQ ID NO: 8075 - protein, 9 aa, Homo sapiens
  Light chain CDR3 for antibody 4038 (IGKV1-9)
QQLNGFPYT

SEQ ID NO: 8076 - protein, 15 aa, Homo sapiens
  Heavy chain CDR3 for antibody 4038 (IGHV1-46)
AREKYYGAGSYAFDY

SEQ ID NO: 8077 - protein, 9 aa, Homo sapiens
  Light chain CDR3 for antibody 4039 (IGKV1-9)
QQFNSHPFT

SEQ ID NO: 8078 - protein, 17 aa, Homo sapiens
  Heavy chain CDR3 for antibody 4039 (IGHV3-33)
AREISVLRGANSYGLDV

SEQ ID NO: 8079 - protein, 9 aa, Homo sapiens
  Light chain CDR3 for antibody 4040 (IGKV1-9)
QQLNSYPYT

SEQ ID NO: 8080 - protein, 15 aa, Homo sapiens
  Heavy chain CDR3 for antibody 4040 (IGHV1-46)
AREKYYGAGSYAIEY

SEQ ID NO: 8081 - protein, 9 aa, Homo sapiens
  Light chain CDR3 for antibody 4041 (IGKV1-9)
QQLISYPYT

SEQ ID NO: 8082 - protein, 15 aa, Homo sapiens
  Heavy chain CDR3 for antibody 4041 (IGHV1-46)
AREKYEGAGSYPIDY

SEQ ID NO: 8083 - protein, 9 aa, Homo sapiens
  Light chain CDR3 for antibody 4042 (IGKV1-13)
QQFNSHPFT

SEQ ID NO: 8084 - protein, 9 aa, Homo sapiens
  Heavy chain CDR3 for antibody 4042 (IGHV3-23)
AKDELGIDY

SEQ ID NO: 8085 - protein, 9 aa, Homo sapiens
  Light chain CDR3 for antibody 4043 (IGKV1-9)
QQLNSYPFT

SEQ ID NO: 8086 - protein, 17 aa, Homo sapiens
  Heavy chain CDR3 for antibody 4043 (IGHV3-33)
VREITMVRGDTYDGMDD

SEQ ID NO: 8087 - protein, 9 aa, Homo sapiens
  Light chain CDR3 for antibody 4044 (IGKV1-9)
QQLNGYPYT

SEQ ID NO: 8088 - protein, 16 aa, Homo sapiens
  Heavy chain CDR3 for antibody 4044 (IGHV1-46)
AREGDTMVRGVIAFES

SEQ ID NO: 8089 - protein, 9 aa, Homo sapiens
  Light chain CDR3 for antibody 4045 (IGKV1-9)
QQLNGYPYT

SEQ ID NO: 8090 - protein, 13 aa, Homo sapiens
  Heavy chain CDR3 for antibody 4045 (IGHV1-18)
AREGGSFYVSFDY

SEQ ID NO: 8091 - protein, 9 aa, Homo sapiens
  Light chain CDR3 for antibody 4046 (IGKV1-9)
QQLNSYPFT

SEQ ID NO: 8092 - protein, 17 aa, Homo sapiens
  Heavy chain CDR3 for antibody 4046 (IGHV3-33)
EREIAMVRGDYYYGMEV

SEQ ID NO: 8093 - protein, 9 aa, Homo sapiens
  Light chain CDR3 for antibody 4047 (IGKV1D-17)
LQHTSYPYT

SEQ ID NO: 8094 - protein, 15 aa, Homo sapiens
  Heavy chain CDR3 for antibody 4047 (IGHV1-46)
AREKYYGSGSYPFDY

SEQ ID NO: 8095 - protein, 9 aa, Homo sapiens
  Light chain CDR3 for antibody 4048 (IGKV1D-17)
LQHNSYPYT

SEQ ID NO: 8096 - protein, 16 aa, Homo sapiens
  Heavy chain CDR3 for antibody 4048 (IGHV3-33)
ARFGYSYGYDYCGMDV

SEQ ID NO: 8097 - protein, 9 aa, Homo sapiens
  Light chain CDR3 for antibody 4049 (IGKV1-9)
QQFNSHPFT

SEQ ID NO: 8098 - protein, 17 aa, Homo sapiens
  Heavy chain CDR3 for antibody 4049 (IGHV3-33)
AREIPMVRGDNYYGLDA

SEQ ID NO: 8099 - protein, 9 aa, Homo sapiens
  Light chain CDR3 for antibody 4050 (IGKV1-9)
QQLNSYPYT

SEQ ID NO: 8100 - protein, 15 aa, Homo sapiens
  Heavy chain CDR3 for antibody 4050 (IGHV1-46)
AIEKYYGAGSYPIDD

SEQ ID NO: 8101 - protein, 9 aa, Homo sapiens
  Light chain CDR3 for antibody 4051 (IGKV1-9)
QQLNSYPYT

SEQ ID NO: 8102 - protein, 13 aa, Homo sapiens
  Heavy chain CDR3 for antibody 4051 (IGHV3-30)
ARDYCGGDGYHDP

SEQ ID NO: 8103 - protein, 9 aa, Homo sapiens
  Light chain CDR3 for antibody 4052 (IGKV1-9)
QQFNSHPFT

SEQ ID NO: 8104 - protein, 17 aa, Homo sapiens
  Heavy chain CDR3 for antibody 4052 (IGHV3-33)
AREITMVRGDNYSGLDA

SEQ ID NO: 8105 - protein, 9 aa, Homo sapiens
  Light chain CDR3 for antibody 4053 (IGKV1D-17)
QQLNSYPYT

SEQ ID NO: 8106 - protein, 15 aa, Homo sapiens
  Heavy chain CDR3 for antibody 4053 (IGHV1-46)
ARQKYYGSAIYPFDY

SEQ ID NO: 8107 - protein, 9 aa, Homo sapiens
  Light chain CDR3 for antibody 4054 (IGKV6-21)
HQSSSLPYT

SEQ ID NO: 8108 - protein, 13 aa, Homo sapiens
  Heavy chain CDR3 for antibody 4054 (IGHV1-46)
ARGTGTTGASFDY

SEQ ID NO: 8109 - protein, 9 aa, Homo sapiens
  Light chain CDR3 for antibody 4055 (IGKV1D-17)
LQHNSYPYT

SEQ ID NO: 8110 - protein, 10 aa, Homo sapiens
  Heavy chain CDR3 for antibody 4055 (IGHV3-33)
AIEAVAAFDY

SEQ ID NO: 8111 - protein, 9 aa, Homo sapiens
  Light chain CDR3 for antibody 4056 (IGKV1-9)
QQLNGYPYT

SEQ ID NO: 8112 - protein, 15 aa, Homo sapiens
  Heavy chain CDR3 for antibody 4056 (IGHV1-46)
ARAKSYGSWCYPFDY

SEQ ID NO: 8113 - protein, 9 aa, Homo sapiens
  Light chain CDR3 for antibody 4057 (IGKV1-9)
QQLNSYPYT

SEQ ID NO: 8114 - protein, 10 aa, Homo sapiens
  Heavy chain CDR3 for antibody 4057 (IGHV3-33)
AREAVAGFDY

SEQ ID NO: 8115 - protein, 9 aa, Homo sapiens
  Light chain CDR3 for antibody 4058 (IGKV1-9)
QQLNSYPLT

SEQ ID NO: 8116 - protein, 15 aa, Homo sapiens
  Heavy chain CDR3 for antibody 4058 (IGHV1-46)
AREGLSGYDPNCFDS

SEQ ID NO: 8117 - protein, 9 aa, Homo sapiens
  Light chain CDR3 for antibody 4059 (IGKV1-9)
QQLNSYPLT

SEQ ID NO: 8118 - protein, 19 aa, Homo sapiens
  Heavy chain CDR3 for antibody 4059 (IGHV4-59)
ARDGRDILTGYNYYYGMDV

SEQ ID NO: 8119 - protein, 9 aa, Homo sapiens
  Light chain CDR3 for antibody 4060 (IGKV1-9)
QQLNGFPYT

SEQ ID NO: 8120 - protein, 15 aa, Homo sapiens
  Heavy chain CDR3 for antibody 4060 (IGHV1-46)
AIDKYYGSWSYPFDY

SEQ ID NO: 8121 - protein, 9 aa, Homo sapiens
  Light chain CDR3 for antibody 4061 (IGKV1-9)
HQLNSYPYT

SEQ ID NO: 8122 - protein, 15 aa, Homo sapiens
  Heavy chain CDR3 for antibody 4061 (IGHV1-46)
AREKYYGSGSYPLYY

SEQ ID NO: 8123 - protein, 9 aa, Homo sapiens
  Light chain CDR3 for antibody 4062 (IGKV1-9)
QQFNSYPFT

SEQ ID NO: 8124 - protein, 17 aa, Homo sapiens
  Heavy chain CDR3 for antibody 4062 (IGHV3-33)
AREITMVRGDNYYGMEA

SEQ ID NO: 8125 - protein, 9 aa, Homo sapiens
  Light chain CDR3 for antibody 4063 (IGKV1-9)
QQLNSYPFT

SEQ ID NO: 8126 - protein, 17 aa, Homo sapiens
  Heavy chain CDR3 for antibody 4063 (IGHV3-33)
AREIAMVRGDSYYGMDA

SEQ ID NO: 8127 - protein, 9 aa, Homo sapiens
  Light chain CDR3 for antibody 4064 (IGKV1D-17)
QQHNSYPYT

SEQ ID NO: 8128 - protein, 9 aa, Homo sapiens
  Heavy chain CDR3 for antibody 4064 (IGHV3-23)
AKDELGIDY

SEQ ID NO: 8129 - protein, 9 aa, Homo sapiens
  Light chain CDR3 for antibody 4065 (IGKV1-9)
QQLNSYPYT

SEQ ID NO: 8130 - protein, 15 aa, Homo sapiens
  Heavy chain CDR3 for antibody 4065 (IGHV1-46)
AREKYHGAGSYRFDY

SEQ ID NO: 8131 - protein, 9 aa, Homo sapiens
  Light chain CDR3 for antibody 4066 (IGKV5-2)
LQHDNFPWT

SEQ ID NO: 8132 - protein, 10 aa, Homo sapiens
  Heavy chain CDR3 for antibody 4066 (IGHV3-33)
ARESVAGFDY

SEQ ID NO: 8133 - protein, 9 aa, Homo sapiens
  Light chain CDR3 for antibody 4067 (IGKV1-9)
QQLNSYQFT

SEQ ID NO: 8134 - protein, 13 aa, Homo sapiens
  Heavy chain CDR3 for antibody 4067 (IGHV3-33)
ARDYCGGDCYPDP

SEQ ID NO: 8135 - protein, 9 aa, Homo sapiens
  Light chain CDR3 for antibody 4068 (IGKV1-9)
QQLDSYPFT

SEQ ID NO: 8136 - protein, 17 aa, Homo sapiens
  Heavy chain CDR3 for antibody 4068 (IGHV3-33)
AREIAIVRGDNYYGLDV

SEQ ID NO: 8137 - protein, 9 aa, Homo sapiens
  Light chain CDR3 for antibody 4069 (IGKV6-21)
HQSSSLPYT

SEQ ID NO: 8138 - protein, 16 aa, Homo sapiens
  Heavy chain CDR3 for antibody 4069 (IGHV1-18)
AREEDTMVRGVNAFDY

SEQ ID NO: 8139 - protein, 9 aa, Homo sapiens
  Light chain CDR3 for antibody 4070 (IGKV1-9)
HQLNSYPYT

SEQ ID NO: 8140 - protein, 15 aa, Homo sapiens
  Heavy chain CDR3 for antibody 4070 (IGHV1-46)
AREKCYGSESYPFAY

SEQ ID NO: 8141 - protein, 9 aa, Homo sapiens
  Light chain CDR3 for antibody 4071 (IGKV1-9)
QQLNSYPFT

SEQ ID NO: 8142 - protein, 17 aa, Homo sapiens
  Heavy chain CDR3 for antibody 4071 (IGHV3-33)
AREITRVRGYNYYAMDA

SEQ ID NO: 8143 - protein, 9 aa, Homo sapiens
  Light chain CDR3 for antibody 4072 (IGKV6-21)
HQSSSLPYT

SEQ ID NO: 8144 - protein, 13 aa, Homo sapiens
  Heavy chain CDR3 for antibody 4072 (IGHV1-18)
AREGGNYYVAFDY

SEQ ID NO: 8145 - protein, 9 aa, Homo sapiens
  Light chain CDR3 for antibody 4073 (IGKV3-11)
QQRSNWPRT

SEQ ID NO: 8146 - protein, 15 aa, Homo sapiens
  Heavy chain CDR3 for antibody 4073 (IGHV1-46)
AREKYYGSGSYPFDY

SEQ ID NO: 8147 - protein, 9 aa, Homo sapiens
  Light chain CDR3 for antibody 4074 (IGKV1-17)
LQHNSYPWT

SEQ ID NO: 8148 - protein, 14 aa, Homo sapiens
  Heavy chain CDR3 for antibody 4074 (IGHV3-23)
AKVLLWFGEHGMDV

SEQ ID NO: 8149 - protein, 9 aa, Homo sapiens
  Light chain CDR3 for antibody 4075 (IGKV1-9)
QQLNSYPLT

SEQ ID NO: 8150 - protein, 15 aa, Homo sapiens
  Heavy chain CDR3 for antibody 4075 (IGHV1-46)
AREKCHGSGSYPFDY

SEQ ID NO: 8151 - protein, 9 aa, Homo sapiens
  Light chain CDR3 for antibody 4076 (IGKV1-9)
QQLNGYPYT

SEQ ID NO: 8152 - protein, 15 aa, Homo sapiens
  Heavy chain CDR3 for antibody 4076 (IGHV1-46)
AREKDYGAGSYALDD

SEQ ID NO: 8153 - protein, 9 aa, Homo sapiens
  Light chain CDR3 for antibody 4077 (IGKV1-9)
QQLNSYPYT

SEQ ID NO: 8154 - protein, 13 aa, Homo sapiens
  Heavy chain CDR3 for antibody 4077 (IGHV3-11)
ARYYCRGDYYIDP

SEQ ID NO: 8155 - protein, 9 aa, Homo sapiens
  Light chain CDR3 for antibody 4078 (IGKV1-9)
QQLNSYPFT

SEQ ID NO: 8156 - protein, 12 aa, Homo sapiens
  Heavy chain CDR3 for antibody 4078 (IGHV3-20)
ARDWGDGDYFDY

SEQ ID NO: 8157 - protein, 9 aa, Homo sapiens
  Light chain CDR3 for antibody 4079 (IGKV1-9)
QQLNSYPFT

SEQ ID NO: 8158 - protein, 17 aa, Homo sapiens
  Heavy chain CDR3 for antibody 4079 (IGHV3-66)
ARESTMVRGESYYGMDV

SEQ ID NO: 8159 - protein, 9 aa, Homo sapiens
  Light chain CDR3 for antibody 4080 (IGKV1-9)
QQLNGFPYT

SEQ ID NO: 8160 - protein, 15 aa, Homo sapiens
  Heavy chain CDR3 for antibody 4080 (IGHV1-46)
AREKCQGSGSYPFDY

SEQ ID NO: 8161 - protein, 9 aa, Homo sapiens
  Light chain CDR3 for antibody 4081 (IGKV1-9)
QQLNGYPYP

SEQ ID NO: 8162 - protein, 15 aa, Homo sapiens
  Heavy chain CDR3 for antibody 4081 (IGHV1-46)
AREKYYGSDTYPFDY

SEQ ID NO: 8163 - protein, 9 aa, Homo sapiens
  Light chain CDR3 for antibody 4082 (IGKV1-9)
QQLNSYPYT

SEQ ID NO: 8164 - protein, 15 aa, Homo sapiens
  Heavy chain CDR3 for antibody 4082 (IGHV1-46)
AREKSYGSGRYPFDS

SEQ ID NO: 8165 - protein, 9 aa, Homo sapiens
  Light chain CDR3 for antibody 4083 (IGKV1-9)
QQLNGYPYT

SEQ ID NO: 8166 - protein, 15 aa, Homo sapiens
  Heavy chain CDR3 for antibody 4083 (IGHV1-46)
AREKDHGSGSYPFEY

SEQ ID NO: 8167 - protein, 9 aa, Homo sapiens
  Light chain CDR3 for antibody 4084 (IGKV1-9)
QQLNSYPFT

SEQ ID NO: 8168 - protein, 17 aa, Homo sapiens
  Heavy chain CDR3 for antibody 4084 (IGHV3-33)
AREITGIRGDNYYGMAV

SEQ ID NO: 8169 - protein, 9 aa, Homo sapiens
  Light chain CDR3 for antibody 4085 (IGKV1-9)
QQLNGYPYT

SEQ ID NO: 8170 - protein, 15 aa, Homo sapiens
  Heavy chain CDR3 for antibody 4085 (IGHV1-46)
AREKSYGPGSYPFDY

SEQ ID NO: 8171 - protein, 9 aa, Homo sapiens
  Light chain CDR3 for antibody 4086 (IGKV6-21)
HQSSSLPYT

SEQ ID NO: 8172 - protein, 13 aa, Homo sapiens
  Heavy chain CDR3 for antibody 4086 (IGHV1-18)
AREGGSFYVAFEY

SEQ ID NO: 8173 - protein, 9 aa, Homo sapiens
  Light chain CDR3 for antibody 4087 (IGKV1-9)
QQLNGYPYT

SEQ ID NO: 8174 - protein, 15 aa, Homo sapiens
  Heavy chain CDR3 for antibody 4087 (IGHV1-46)
AREKYYGSATSPFDS

SEQ ID NO: 8175 - protein, 9 aa, Homo sapiens
  Light chain CDR3 for antibody 4088 (IGKV1-9)
QQFNSYPFT

SEQ ID NO: 8176 - protein, 17 aa, Homo sapiens
  Heavy chain CDR3 for antibody 4088 (IGHV3-33)
AREITRVRGDNYDGMDV

SEQ ID NO: 8177 - protein, 9 aa, Homo sapiens
  Light chain CDR3 for antibody 4089 (IGKV1-9)
QQFNSFPFT

SEQ ID NO: 8178 - protein, 17 aa, Homo sapiens
  Heavy chain CDR3 for antibody 4089 (IGHV3-33)
AREIHLVRGANSYGLDV

SEQ ID NO: 8179 - protein, 9 aa, Homo sapiens
  Light chain CDR3 for antibody 4090 (IGKV1-9)
QQLNSYPYT

SEQ ID NO: 8180 - protein, 15 aa, Homo sapiens
  Heavy chain CDR3 for antibody 4090 (IGHV1-46)
AREKYYGSVTYPFEY

SEQ ID NO: 8181 - protein, 9 aa, Homo sapiens
  Light chain CDR3 for antibody 4091 (IGKV1-9)
QQLNSYPYT

SEQ ID NO: 8182 - protein, 17 aa, Homo sapiens
  Heavy chain CDR3 for antibody 4091 (IGHV3-33)
AREITRVRGEKYYGMDV

SEQ ID NO: 8183 - protein, 9 aa, Homo sapiens
  Light chain CDR3 for antibody 4092 (IGKV1-9)
QQFNSHPFT

SEQ ID NO: 8184 - protein, 17 aa, Homo sapiens
  Heavy chain CDR3 for antibody 4092 (IGHV3-33)
AREITMVRGDTYYGMDG

SEQ ID NO: 8185 - protein, 9 aa, Homo sapiens
  Light chain CDR3 for antibody 4093 (IGKV6-21)
HQSSSLPYT

SEQ ID NO: 8186 - protein, 13 aa, Homo sapiens
  Heavy chain CDR3 for antibody 4093 (IGHV1-18)
AKEVGSYIDSFDY

SEQ ID NO: 8187 - protein, 9 aa, Homo sapiens
  Light chain CDR3 for antibody 4094 (IGKV1-9)
QQLNGYPYT

SEQ ID NO: 8188 - protein, 15 aa, Homo sapiens
  Heavy chain CDR3 for antibody 4094 (IGHV1-46)
AREKYYVSATYPFDY

SEQ ID NO: 8189 - protein, 9 aa, Homo sapiens
  Light chain CDR3 for antibody 4095 (IGKV1D-17)
LQHNSYPYT

SEQ ID NO: 8190 - protein, 17 aa, Homo sapiens
  Heavy chain CDR3 for antibody 4095 (IGHV3-33)
AREITMIRGENYYGLDV

SEQ ID NO: 8191 - protein, 9 aa, Homo sapiens
  Light chain CDR3 for antibody 4096 (IGKV1D-17)
LQHNSYPFT

SEQ ID NO: 8192 - protein, 17 aa, Homo sapiens
  Heavy chain CDR3 for antibody 4096 (IGHV3-33)
AREITMFRGDNYYGLDV

SEQ ID NO: 8193 - protein, 9 aa, Homo sapiens
  Light chain CDR3 for antibody 4097 (IGKV1-9)
LQLNSYPYT

SEQ ID NO: 8194 - protein, 15 aa, Homo sapiens
  Heavy chain CDR3 for antibody 4097 (IGHV1-46)
ARENYYGSGSYPFDY

SEQ ID NO: 8195 - protein, 9 aa, Homo sapiens
  Light chain CDR3 for antibody 4098 (IGKV1D-17)
LQHNSYPYT

SEQ ID NO: 8196 - protein, 10 aa, Homo sapiens
  Heavy chain CDR3 for antibody 4098 (IGHV3-33)
AREYTDAIDV

SEQ ID NO: 8197 - protein, 9 aa, Homo sapiens
  Light chain CDR3 for antibody 4099 (IGKV1-9)
QQFNSYPFT

SEQ ID NO: 8198 - protein, 6 aa, Homo sapiens
  Heavy chain CDR3 for antibody 4099 (IGHV3-33)
AREIDY

SEQ ID NO: 8199 - protein, 9 aa, Homo sapiens
  Light chain CDR3 for antibody 4100 (IGKV1-17)
LQHNSYPWT

SEQ ID NO: 8200 - protein, 13 aa, Homo sapiens
  Heavy chain CDR3 for antibody 4100 (IGHV3-23)
AKGGTMVRDIGYY

SEQ ID NO: 8201 - protein, 9 aa, Homo sapiens
  Light chain CDR3 for antibody 4101 (IGKV1-9)
QQLNGYPYT

SEQ ID NO: 8202 - protein, 15 aa, Homo sapiens
  Heavy chain CDR3 for antibody 4101 (IGHV1-46)
AREKYYGAGSYPFES

SEQ ID NO: 8203 - protein, 9 aa, Homo sapiens
  Light chain CDR3 for antibody 4102 (IGKV1-9)
QQLNSYPLT

SEQ ID NO: 8204 - protein, 15 aa, Homo sapiens
  Heavy chain CDR3 for antibody 4102 (IGHV1-46)
AREKYYGSGSYPIDY

SEQ ID NO: 8205 - protein, 9 aa, Homo sapiens
  Light chain CDR3 for antibody 4103 (IGKV1-9)
QQLNSYPFT

SEQ ID NO: 8206 - protein, 10 aa, Homo sapiens
  Heavy chain CDR3 for antibody 4103 (IGHV3-33)
AREGVGGMDV

SEQ ID NO: 8207 - protein, 9 aa, Homo sapiens
  Light chain CDR3 for antibody 4104 (IGKV1-9)
QHLNSYPFT

SEQ ID NO: 8208 - protein, 17 aa, Homo sapiens
  Heavy chain CDR3 for antibody 4104 (IGHV3-33)
AREITMVRGDNYDGMDG

SEQ ID NO: 8209 - protein, 9 aa, Homo sapiens
  Light chain CDR3 for antibody 4105 (IGKV1-9)
QQFNSHPFT

SEQ ID NO: 8210 - protein, 17 aa, Homo sapiens
  Heavy chain CDR3 for antibody 4105 (IGHV3-33)
ARESTMVRGENYYGLDV

SEQ ID NO: 8211 - protein, 9 aa, Homo sapiens
  Light chain CDR3 for antibody 4106 (IGKV1-9)
QQLNGYPYT

SEQ ID NO: 8212 - protein, 15 aa, Homo sapiens
  Heavy chain CDR3 for antibody 4106 (IGHV1-46)
AREKYFGSGSYPFAY

SEQ ID NO: 8213 - protein, 9 aa, Homo sapiens
  Light chain CDR3 for antibody 4107 (IGKV1-6)
LQDYNYPWT

SEQ ID NO: 8214 - protein, 16 aa, Homo sapiens
  Heavy chain CDR3 for antibody 4107 (IGHV3-33)
ARDYEILTEAYYGMDV

SEQ ID NO: 8215 - protein, 9 aa, Homo sapiens
  Light chain CDR3 for antibody 4108 (IGKV1-9)
QQLNSYPYT

SEQ ID NO: 8216 - protein, 15 aa, Homo sapiens
  Heavy chain CDR3 for antibody 4108 (IGHV1-18)
AREKYHGSGSYAMDY

SEQ ID NO: 8217 - protein, 9 aa, Homo sapiens
  Light chain CDR3 for antibody 4109 (IGKV1-9)
QQLNSYPYT

SEQ ID NO: 8218 - protein, 17 aa, Homo sapiens
  Heavy chain CDR3 for antibody 4109 (IGHV3-33)
AREITRVRGANYYGLDG

SEQ ID NO: 8219 - protein, 9 aa, Homo sapiens
  Light chain CDR3 for antibody 4110 (IGKV1-8)
QQLNSYPYT

SEQ ID NO: 8220 - protein, 16 aa, Homo sapiens
  Heavy chain CDR3 for antibody 4110 (IGHV1-46)
ARGYVVVPAAVDAFDI

SEQ ID NO: 8221 - protein, 9 aa, Homo sapiens
  Light chain CDR3 for antibody 4111 (IGKV1-9)
QQLNGYPYT

SEQ ID NO: 8222 - protein, 15 aa, Homo sapiens
  Heavy chain CDR3 for antibody 4111 (IGHV1-46)
AREKYYGSGRYPLDY

SEQ ID NO: 8223 - protein, 9 aa, Homo sapiens
  Light chain CDR3 for antibody 4112 (IGKV1D-17)
LQHNSYPYT

SEQ ID NO: 8224 - protein, 17 aa, Homo sapiens
  Heavy chain CDR3 for antibody 4112 (IGHV3-20)
ARDYYGSGSYYNDAFAI

SEQ ID NO: 8225 - protein, 9 aa, Homo sapiens
  Light chain CDR3 for antibody 4113 (IGKV1-9)
QQLNSYPFT

SEQ ID NO: 8226 - protein, 15 aa, Homo sapiens
  Heavy chain CDR3 for antibody 4113 (IGHV1-46)
AREKSYGSGSYPFDD

SEQ ID NO: 8227 - protein, 9 aa, Homo sapiens
  Light chain CDR3 for antibody 4114 (IGKV1D-17)
LQHNSYPYT

SEQ ID NO: 8228 - protein, 10 aa, Homo sapiens
  Heavy chain CDR3 for antibody 4114 (IGHV3-33)
ARETVSGIDY

SEQ ID NO: 8229 - protein, 9 aa, Homo sapiens
  Light chain CDR3 for antibody 4115 (IGKV1-9)
QQLNSYPYT

SEQ ID NO: 8230 - protein, 17 aa, Homo sapiens
  Heavy chain CDR3 for antibody 4115 (IGHV3-33)
AREITIVRGANYYGMDV

SEQ ID NO: 8231 - protein, 9 aa, Homo sapiens
  Light chain CDR3 for antibody 4116 (IGKV1-9)
QQLNSYPYT

SEQ ID NO: 8232 - protein, 15 aa, Homo sapiens
  Heavy chain CDR3 for antibody 4116 (IGHV1-46)
AREKYYGAGRYPFDY

SEQ ID NO: 8233 - protein, 9 aa, Homo sapiens
  Light chain CDR3 for antibody 4117 (IGKV1-9)
QQLISYPYT

SEQ ID NO: 8234 - protein, 15 aa, Homo sapiens
  Heavy chain CDR3 for antibody 4117 (IGHV1-46)
AREKNYGAGSYPIDY

SEQ ID NO: 8235 - protein, 9 aa, Homo sapiens
  Light chain CDR3 for antibody 4118 (IGKV1-9)
QQFNSHPLT

SEQ ID NO: 8236 - protein, 17 aa, Homo sapiens
  Heavy chain CDR3 for antibody 4118 (IGHV3-33)
ARESTRVRGDNYYGLDV

SEQ ID NO: 8237 - protein, 9 aa, Homo sapiens
  Light chain CDR3 for antibody 4119 (IGKV1D-17)
LQHNSYPYT

SEQ ID NO: 8238 - protein, 15 aa, Homo sapiens
  Heavy chain CDR3 for antibody 4119 (IGHV1-46)
AREKYYGAGSYPFDC

SEQ ID NO: 8239 - protein, 9 aa, Homo sapiens
  Light chain CDR3 for antibody 4120 (IGKV1-9)
QQLNSYPYT

SEQ ID NO: 8240 - protein, 15 aa, Homo sapiens
  Heavy chain CDR3 for antibody 4120 (IGHV1-46)
AREKFPGSESYPFDY

SEQ ID NO: 8241 - protein, 9 aa, Homo sapiens
  Light chain CDR3 for antibody 4121 (IGKV6-21)
HQSSSLPYT

SEQ ID NO: 8242 - protein, 14 aa, Homo sapiens
  Heavy chain CDR3 for antibody 4121 (IGHV1-18)
AREGYSGYLVSIEY

SEQ ID NO: 8243 - protein, 9 aa, Homo sapiens
  Light chain CDR3 for antibody 4122 (IGKV1-9)
QQLNSYPFT

SEQ ID NO: 8244 - protein, 17 aa, Homo sapiens
  Heavy chain CDR3 for antibody 4122 (IGHV3-33)
AREIAMGRGENYYGMDA

SEQ ID NO: 8245 - protein, 9 aa, Homo sapiens
  Light chain CDR3 for antibody 4123 (IGKV1-9)
QQLNSYPYT

SEQ ID NO: 8246 - protein, 16 aa, Homo sapiens
  Heavy chain CDR3 for antibody 4123 (IGHV3-33)
ARIAAAGYYYYYGMDV

SEQ ID NO: 8247 - protein, 9 aa, Homo sapiens
  Light chain CDR3 for antibody 4124 (IGKV1-9)
QQFNSYPFT

SEQ ID NO: 8248 - protein, 17 aa, Homo sapiens
  Heavy chain CDR3 for antibody 4124 (IGHV3-33)
AREVTMVGGDNYYGLDV

SEQ ID NO: 8249 - protein, 9 aa, Homo sapiens
  Light chain CDR3 for antibody 4125 (IGKV1-9)
QQLNSYPYT

SEQ ID NO: 8250 - protein, 17 aa, Homo sapiens
  Heavy chain CDR3 for antibody 4125 (IGHV3-33)
AREITMVWGDNYYCMDV

SEQ ID NO: 8251 - protein, 9 aa, Homo sapiens
  Light chain CDR3 for antibody 4126 (IGKV1-9)
QQFNSHPFT

SEQ ID NO: 8252 - protein, 17 aa, Homo sapiens
  Heavy chain CDR3 for antibody 4126 (IGHV3-33)
AREMTMGPGDNYYGMDV

SEQ ID NO: 8253 - protein, 9 aa, Homo sapiens
  Light chain CDR3 for antibody 4127 (IGKV1-9)
QQLNSYPYT

SEQ ID NO: 8254 - protein, 15 aa, Homo sapiens
  Heavy chain CDR3 for antibody 4127 (IGHV1-46)
AREKSYVSASYPIAY

SEQ ID NO: 8255 - protein, 9 aa, Homo sapiens
  Light chain CDR3 for antibody 4128 (IGKV1D-17)
LQHNSYPYT

SEQ ID NO: 8256 - protein, 11 aa, Homo sapiens
  Heavy chain CDR3 for antibody 4128 (IGHV3-33)
AREWQWLATDY

SEQ ID NO: 8257 - protein, 10 aa, Homo sapiens
  Light chain CDR3 for antibody 4129 (IGKV3D-20)
QQYGSSLTWT

SEQ ID NO: 8258 - protein, 17 aa, Homo sapiens
  Heavy chain CDR3 for antibody 4129 (IGHV3-33)
AREITMLRGDNYYGLDV

SEQ ID NO: 8259 - protein, 9 aa, Homo sapiens
  Light chain CDR3 for antibody 4130 (IGKV1-9)
QQLNSYPYT

SEQ ID NO: 8260 - protein, 15 aa, Homo sapiens
  Heavy chain CDR3 for antibody 4130 (IGHV1-46)
AGEKYYGAGSYPLDS

SEQ ID NO: 8261 - protein, 10 aa, Homo sapiens
  Light chain CDR3 for antibody 4131 (IGKV3D-20)
QQYGSSLTWT

SEQ ID NO: 8262 - protein, 15 aa, Homo sapiens
  Heavy chain CDR3 for antibody 4131 (IGHV1-46)
AREKYYGSGSYPFDY

SEQ ID NO: 8263 - protein, 9 aa, Homo sapiens
  Light chain CDR3 for antibody 4132 (IGKV1-9)
QQFNSYPFT

SEQ ID NO: 8264 - protein, 17 aa, Homo sapiens
  Heavy chain CDR3 for antibody 4132 (IGHV3-33)
EREITMIRSDNYYCMDV

SEQ ID NO: 8265 - protein, 9 aa, Homo sapiens
  Light chain CDR3 for antibody 4133 (IGKV1-9)
QQLNSYPYT

SEQ ID NO: 8266 - protein, 15 aa, Homo sapiens
  Heavy chain CDR3 for antibody 4133 (IGHV1-46)
AREKFYGSAPYPFDY

SEQ ID NO: 8267 - protein, 9 aa, Homo sapiens
  Light chain CDR3 for antibody 4134 (IGKV1-9)
QQFNSHPFT

SEQ ID NO: 8268 - protein, 17 aa, Homo sapiens
  Heavy chain CDR3 for antibody 4134 (IGHV3-33)
ARESTMVRGDNYYGMEV

SEQ ID NO: 8269 - protein, 9 aa, Homo sapiens
  Light chain CDR3 for antibody 4135 (IGKV1-9)
QQFNSYPFT

SEQ ID NO: 8270 - protein, 17 aa, Homo sapiens
  Heavy chain CDR3 for antibody 4135 (IGHV3-33)
AREITMVRVYNYYGIDV

SEQ ID NO: 8271 - protein, 9 aa, Homo sapiens
  Light chain CDR3 for antibody 4136 (IGKV1-9)
HQLNSYPYT

SEQ ID NO: 8272 - protein, 15 aa, Homo sapiens
  Heavy chain CDR3 for antibody 4136 (IGHV1-46)
AREKYCGSGSYPFDY

SEQ ID NO: 8273 - protein, 9 aa, Homo sapiens
  Light chain CDR3 for antibody 4137 (IGKV1D-17)
LQHNSYPYT

SEQ ID NO: 8274 - protein, 10 aa, Homo sapiens
  Heavy chain CDR3 for antibody 4137 (IGHV3-64)
PRETLAAFDY

SEQ ID NO: 8275 - protein, 9 aa, Homo sapiens
  Light chain CDR3 for antibody 4138 (IGKV1D-17)
LQHNSYPYT

SEQ ID NO: 8276 - protein, 10 aa, Homo sapiens
  Heavy chain CDR3 for antibody 4138 (IGHV3-64)
SRESISGFDY

SEQ ID NO: 8277 - protein, 9 aa, Homo sapiens
  Light chain CDR3 for antibody 4139 (IGKV1-9)
QQLNSYPFT

SEQ ID NO: 8278 - protein, 17 aa, Homo sapiens
  Heavy chain CDR3 for antibody 4139 (IGHV3-33)
ARDITLFRGDNYYGMDV

SEQ ID NO: 8279 - protein, 9 aa, Homo sapiens
  Light chain CDR3 for antibody 4140 (IGKV1-9)
QQLNGYPYT

SEQ ID NO: 8280 - protein, 15 aa, Homo sapiens
  Heavy chain CDR3 for antibody 4140 (IGHV1-46)
AREKYYGSGSDPFGY

SEQ ID NO: 8281 - protein, 9 aa, Homo sapiens
  Light chain CDR3 for antibody 4141 (IGKV1-9)
QQHNSYPYT

SEQ ID NO: 8282 - protein, 13 aa, Homo sapiens
  Heavy chain CDR3 for antibody 4141 (IGHV3-13)
ARGGWELFDAFDI

SEQ ID NO: 8283 - protein, 9 aa, Homo sapiens
  Light chain CDR3 for antibody 4142 (IGKV1-9)
HQLNSYPYT

SEQ ID NO: 8284 - protein, 15 aa, Homo sapiens
  Heavy chain CDR3 for antibody 4142 (IGHV1-46)
AREKYFGPGSYPFEY

SEQ ID NO: 8285 - protein, 9 aa, Homo sapiens
  Light chain CDR3 for antibody 4143 (IGKV1-9)
HQLNSYPYT

SEQ ID NO: 8286 - protein, 15 aa, Homo sapiens
  Heavy chain CDR3 for antibody 4143 (IGHV1-46)
AREKYYGSGSYAFDY

SEQ ID NO: 8287 - protein, 9 aa, Homo sapiens
  Light chain CDR3 for antibody 4144 (IGKV6-21)
HQSSSLPYT

SEQ ID NO: 8288 - protein, 13 aa, Homo sapiens
  Heavy chain CDR3 for antibody 4144 (IGHV1-18)
AREGGSCYVSFDY

SEQ ID NO: 8289 - protein, 9 aa, Homo sapiens
  Light chain CDR3 for antibody 4145 (IGKV1-9)
QQLNGYPYT

SEQ ID NO: 8290 - protein, 17 aa, Homo sapiens
  Heavy chain CDR3 for antibody 4145 (IGHV3-11)
AREITMVRGDNYYGIEA

SEQ ID NO: 8291 - protein, 9 aa, Homo sapiens
  Light chain CDR3 for antibody 4146 (IGKV1-9)
QQLNSYPYT

SEQ ID NO: 8292 - protein, 15 aa, Homo sapiens
  Heavy chain CDR3 for antibody 4146 (IGHV1-46)
AIQKYYGSKTYPFDY

SEQ ID NO: 8293 - protein, 9 aa, Homo sapiens
  Light chain CDR3 for antibody 4147 (IGKV1-9)
QQFNSHPFT

SEQ ID NO: 8294 - protein, 17 aa, Homo sapiens
  Heavy chain CDR3 for antibody 4147 (IGHV3-33)
AREITMIRGDNYYGFDV

SEQ ID NO: 8295 - protein, 9 aa, Homo sapiens
  Light chain CDR3 for antibody 4148 (IGKV1-9)
QQLNSYPYT

SEQ ID NO: 8296 - protein, 15 aa, Homo sapiens
  Heavy chain CDR3 for antibody 4148 (IGHV1-46)
AREKYYGSESYRFDY

SEQ ID NO: 8297 - protein, 9 aa, Homo sapiens
  Light chain CDR3 for antibody 4149 (IGKV1-9)
QQLNSYPYT

SEQ ID NO: 8298 - protein, 18 aa, Homo sapiens
  Heavy chain CDR3 for antibody 4149 (IGHV1-46)
VRERNTMVRGDNYYGMDV

SEQ ID NO: 8299 - protein, 9 aa, Homo sapiens
  Light chain CDR3 for antibody 4150 (IGKV1-9)
QQLNSYPYT

SEQ ID NO: 8300 - protein, 15 aa, Homo sapiens
  Heavy chain CDR3 for antibody 4150 (IGHV1-18)
AREKCYGAGIYAFDY

SEQ ID NO: 8301 - protein, 9 aa, Homo sapiens
  Light chain CDR3 for antibody 4151 (IGKV1-9)
QQLNSYPFT

SEQ ID NO: 8302 - protein, 17 aa, Homo sapiens
  Heavy chain CDR3 for antibody 4151 (IGHV3-33)
VREITMGRGENYYGMDV

SEQ ID NO: 8303 - protein, 9 aa, Homo sapiens
  Light chain CDR3 for antibody 4152 (IGKV1D-17)
LQHNSYPYT

SEQ ID NO: 8304 - protein, 10 aa, Homo sapiens
  Heavy chain CDR3 for antibody 4152 (IGHV3-33)
ARDSTDGIDY

SEQ ID NO: 8305 - protein, 9 aa, Homo sapiens
  Light chain CDR3 for antibody 4153 (IGKV1-9)
QQLNSYPYT

SEQ ID NO: 8306 - protein, 15 aa, Homo sapiens
  Heavy chain CDR3 for antibody 4153 (IGHV1-69)
AREKCYGSGNYPFDQ

SEQ ID NO: 8307 - protein, 9 aa, Homo sapiens
  Light chain CDR3 for antibody 4154 (IGKV1-9)
QQLNGYPYT

SEQ ID NO: 8308 - protein, 15 aa, Homo sapiens
  Heavy chain CDR3 for antibody 4154 (IGHV1-46)
AIEKYYGSATYPFDY

SEQ ID NO: 8309 - protein, 9 aa, Homo sapiens
  Light chain CDR3 for antibody 4155 (IGKV1D-17)
LQHSSYPYT

SEQ ID NO: 8310 - protein, 10 aa, Homo sapiens
  Heavy chain CDR3 for antibody 4155 (IGHV3-33)
ARAATDGIDV

SEQ ID NO: 8311 - protein, 9 aa, Homo sapiens
  Light chain CDR3 for antibody 4156 (IGKV1-9)
QQLNSYPFT

SEQ ID NO: 8312 - protein, 17 aa, Homo sapiens
  Heavy chain CDR3 for antibody 4156 (IGHV3-33)
AREIAMDRGGNYYGIDF

SEQ ID NO: 8313 - protein, 9 aa, Homo sapiens
  Light chain CDR3 for antibody 4157 (IGKV6-21)
HQSSSLPYT

SEQ ID NO: 8314 - protein, 17 aa, Homo sapiens
  Heavy chain CDR3 for antibody 4157 (IGHV3-33)
AREITMLRGDNYYGLDV

SEQ ID NO: 8315 - protein, 9 aa, Homo sapiens
  Light chain CDR3 for antibody 4158 (IGKV1-9)
QQLNSYPYT

SEQ ID NO: 8316 - protein, 13 aa, Homo sapiens
  Heavy chain CDR3 for antibody 4158 (IGHV3-33)
ARDYCGGDCCTDA

SEQ ID NO: 8317 - protein, 9 aa, Homo sapiens
  Light chain CDR3 for antibody 4159 (IGKV1-9)
QQLNSYPFT

SEQ ID NO: 8318 - protein, 17 aa, Homo sapiens
  Heavy chain CDR3 for antibody 4159 (IGHV3-33)
AREMAMVRGDNYYGMDF

SEQ ID NO: 8319 - protein, 9 aa, Homo sapiens
  Light chain CDR3 for antibody 4160 (IGKV1-9)
QQLNSYPYT

SEQ ID NO: 8320 - protein, 15 aa, Homo sapiens
  Heavy chain CDR3 for antibody 4160 (IGHV1-46)
AREKYYVSASYPFHY

SEQ ID NO: 8321 - protein, 9 aa, Homo sapiens
  Light chain CDR3 for antibody 4161 (IGKV1-9)
QQFNSYPFT

SEQ ID NO: 8322 - protein, 17 aa, Homo sapiens
  Heavy chain CDR3 for antibody 4161 (IGHV3-66)
AREITMFRGDTYYGMDV

SEQ ID NO: 8323 - protein, 9 aa, Homo sapiens
  Light chain CDR3 for antibody 4162 (IGKV1-9)
QQLNSYPYT

SEQ ID NO: 8324 - protein, 15 aa, Homo sapiens
  Heavy chain CDR3 for antibody 4162 (IGHV1-46)
ARAKYYGSGSYPFES

SEQ ID NO: 8325 - protein, 9 aa, Homo sapiens
  Light chain CDR3 for antibody 4163 (IGKV1D-17)
LQHNSYPYT

SEQ ID NO: 8326 - protein, 17 aa, Homo sapiens
  Heavy chain CDR3 for antibody 4163 (IGHV3-33)
AREITMRRGDNCYGLDV

SEQ ID NO: 8327 - protein, 9 aa, Homo sapiens
  Light chain CDR3 for antibody 4164 (IGKV1-6)
LQDYNYPWT

SEQ ID NO: 8328 - protein, 15 aa, Homo sapiens
  Heavy chain CDR3 for antibody 4164 (IGHV1-46)
ARDIVVVPAAMGMDV

SEQ ID NO: 8329 - protein, 9 aa, Homo sapiens
  Light chain CDR3 for antibody 4165 (IGKV1-9)
QQLNSYPFT

SEQ ID NO: 8330 - protein, 17 aa, Homo sapiens
  Heavy chain CDR3 for antibody 4165 (IGHV3-33)
AREITLVRGDNYDGLDV

SEQ ID NO: 8331 - protein, 9 aa, Homo sapiens
  Light chain CDR3 for antibody 4166 (IGKV6-21)
HQSSSLPYT

SEQ ID NO: 8332 - protein, 10 aa, Homo sapiens
  Heavy chain CDR3 for antibody 4166 (IGHV3-33)
AREGRTGFDY

SEQ ID NO: 8333 - protein, 9 aa, Homo sapiens
  Light chain CDR3 for antibody 4167 (IGKV1-9)
QQFNSYPFT

SEQ ID NO: 8334 - protein, 15 aa, Homo sapiens
  Heavy chain CDR3 for antibody 4167 (IGHV1-46)
AREKYHGSGSYPFYY

SEQ ID NO: 8335 - protein, 9 aa, Homo sapiens
  Light chain CDR3 for antibody 4168 (IGKV1D-17)
LQHNSYPYT

SEQ ID NO: 8336 - protein, 10 aa, Homo sapiens
  Heavy chain CDR3 for antibody 4168 (IGHV3-33)
ARETYDGFDY

SEQ ID NO: 8337 - protein, 9 aa, Homo sapiens
  Light chain CDR3 for antibody 4169 (IGKV1-9)
QQLNSYPFT

SEQ ID NO: 8338 - protein, 17 aa, Homo sapiens
  Heavy chain CDR3 for antibody 4169 (IGHV3-33)
AKEITMIRGDNYYAIDV

SEQ ID NO: 8339 - protein, 9 aa, Homo sapiens
  Light chain CDR3 for antibody 4170 (IGKV1D-17)
LQHNSYPYT

SEQ ID NO: 8340 - protein, 13 aa, Homo sapiens
  Heavy chain CDR3 for antibody 4170 (IGHV3-11)
ARTGILTGYPFDY

SEQ ID NO: 8341 - protein, 9 aa, Homo sapiens
  Light chain CDR3 for antibody 4171 (IGKV1-9)
PPLNSYPYT

SEQ ID NO: 8342 - protein, 15 aa, Homo sapiens
  Heavy chain CDR3 for antibody 4171 (IGHV1-46)
AREKYYGSGSYPFDY

SEQ ID NO: 8343 - protein, 8 aa, Homo sapiens
  Light chain CDR3 for antibody 4172 (IGKV1D-13)
QQFNNYPT

SEQ ID NO: 8344 - protein, 15 aa, Homo sapiens
  Heavy chain CDR3 for antibody 4172 (IGHV3-33)
ARKGYSSGWYGPADV

SEQ ID NO: 8345 - protein, 9 aa, Homo sapiens
  Light chain CDR3 for antibody 4173 (IGKV1-9)
QQLNSYPYT

SEQ ID NO: 8346 - protein, 15 aa, Homo sapiens
  Heavy chain CDR3 for antibody 4173 (IGHV1-46)
AREKYYGSWSYPFDF

SEQ ID NO: 8347 - protein, 9 aa, Homo sapiens
  Light chain CDR3 for antibody 4174 (IGKV1-9)
QQLNSYPFT

SEQ ID NO: 8348 - protein, 17 aa, Homo sapiens
  Heavy chain CDR3 for antibody 4174 (IGHV3-48)
AREITRVRGANSYGMDF

SEQ ID NO: 8349 - protein, 9 aa, Homo sapiens
  Light chain CDR3 for antibody 4175 (IGKV1D-17)
QQLNSYPYT

SEQ ID NO: 8350 - protein, 15 aa, Homo sapiens
  Heavy chain CDR3 for antibody 4175 (IGHV1-46)
EREKYCGSESYPFDY

SEQ ID NO: 8351 - protein, 9 aa, Homo sapiens
  Light chain CDR3 for antibody 4176 (IGKV1-9)
QQLNSYPFT

SEQ ID NO: 8352 - protein, 17 aa, Homo sapiens
  Heavy chain CDR3 for antibody 4176 (IGHV3-33)
AREITMFRGDNYYGMDF

SEQ ID NO: 8353 - protein, 9 aa, Homo sapiens
  Light chain CDR3 for antibody 4177 (IGKV1-9)
QQLNSYPFT

SEQ ID NO: 8354 - protein, 9 aa, Homo sapiens
  Heavy chain CDR3 for antibody 4177 (IGHV3-33)
ARDDGYFDY

SEQ ID NO: 8355 - protein, 9 aa, Homo sapiens
  Light chain CDR3 for antibody 4178 (IGKV1-9)
QQLNSYPYT

SEQ ID NO: 8356 - protein, 15 aa, Homo sapiens
  Heavy chain CDR3 for antibody 4178 (IGHV1-46)
AREKYHGSGTYAFDY

SEQ ID NO: 8357 - protein, 9 aa, Homo sapiens
  Light chain CDR3 for antibody 4179 (IGKV1-9)
QQLNSYPFT

SEQ ID NO: 8358 - protein, 13 aa, Homo sapiens
  Heavy chain CDR3 for antibody 4179 (IGHV3-33)
ARGGVRGVIGFDY

SEQ ID NO: 8359 - protein, 9 aa, Homo sapiens
  Light chain CDR3 for antibody 4180 (IGKV1-9)
QQFNSYPFT

SEQ ID NO: 8360 - protein, 17 aa, Homo sapiens
  Heavy chain CDR3 for antibody 4180 (IGHV3-33)
AREIAMARGDNYYGLDV

SEQ ID NO: 8361 - protein, 9 aa, Homo sapiens
  Light chain CDR3 for antibody 4181 (IGKV1-9)
QQLNSYPLT

SEQ ID NO: 8362 - protein, 15 aa, Homo sapiens
  Heavy chain CDR3 for antibody 4181 (IGHV1-46)
AREKDYGSGSYPLDY

SEQ ID NO: 8363 - protein, 9 aa, Homo sapiens
  Light chain CDR3 for antibody 4182 (IGKV1-9)
QQLNSYPYT

SEQ ID NO: 8364 - protein, 15 aa, Homo sapiens
  Heavy chain CDR3 for antibody 4182 (IGHV1-46)
AREKSYGSASSPFDY

SEQ ID NO: 8365 - protein, 9 aa, Homo sapiens
  Light chain CDR3 for antibody 4183 (IGKV1-9)
HQLISYPYT

SEQ ID NO: 8366 - protein, 15 aa, Homo sapiens
  Heavy chain CDR3 for antibody 4183 (IGHV1-46)
AREKDYGSGSYPFDY

SEQ ID NO: 8367 - protein, 9 aa, Homo sapiens
  Light chain CDR3 for antibody 4184 (IGKV1-9)
QQLNSYPFT

SEQ ID NO: 8368 - protein, 17 aa, Homo sapiens
  Heavy chain CDR3 for antibody 4184 (IGHV3-33)
EREITRVRGDNYYGMDA

SEQ ID NO: 8369 - protein, 9 aa, Homo sapiens
  Light chain CDR3 for antibody 4185 (IGKV1D-17)
LQHNSYPYT

SEQ ID NO: 8370 - protein, 17 aa, Homo sapiens
  Heavy chain CDR3 for antibody 4185 (IGHV3-33)
ARAITMLRGDTSYGLDV

SEQ ID NO: 8371 - protein, 9 aa, Homo sapiens
  Light chain CDR3 for antibody 4186 (IGKV1-9)
QQFNGYPFT

SEQ ID NO: 8372 - protein, 17 aa, Homo sapiens
  Heavy chain CDR3 for antibody 4186 (IGHV3-33)
SREITMLRGDNYYGLDV

SEQ ID NO: 8373 - protein, 9 aa, Homo sapiens
  Light chain CDR3 for antibody 4187 (IGKV1-9)
QQLNGYPYT

SEQ ID NO: 8374 - protein, 10 aa, Homo sapiens
  Heavy chain CDR3 for antibody 4187 (IGHV3-33)
AREAVAGFEY

SEQ ID NO: 8375 - protein, 9 aa, Homo sapiens
  Light chain CDR3 for antibody 4188 (IGKV1-6)
LQDYNYPYT

SEQ ID NO: 8376 - protein, 10 aa, Homo sapiens
  Heavy chain CDR3 for antibody 4188 (IGHV3-33)
ARESTDGMDV

SEQ ID NO: 8377 - protein, 9 aa, Homo sapiens
  Light chain CDR3 for antibody 4189 (IGKV1-9)
QQLNGYPYT

SEQ ID NO: 8378 - protein, 15 aa, Homo sapiens
  Heavy chain CDR3 for antibody 4189 (IGHV1-46)
AREDYDGSGSYPIDY

SEQ ID NO: 8379 - protein, 9 aa, Homo sapiens
  Light chain CDR3 for antibody 4190 (IGKV1-9)
LQHNSYPYT

SEQ ID NO: 8380 - protein, 9 aa, Homo sapiens
  Heavy chain CDR3 for antibody 4190 (IGHV1-18)
ARGEPNIDY

SEQ ID NO: 8381 - protein, 9 aa, Homo sapiens
  Light chain CDR3 for antibody 4191 (IGKV1-9)
QQLNSYPFT

SEQ ID NO: 8382 - protein, 17 aa, Homo sapiens
  Heavy chain CDR3 for antibody 4191 (IGHV3-33)
AREITKVRGENYYGMDY

SEQ ID NO: 8383 - protein, 9 aa, Homo sapiens
  Light chain CDR3 for antibody 4192 (IGKV1-9)
LQLNSYPYT

SEQ ID NO: 8384 - protein, 15 aa, Homo sapiens
  Heavy chain CDR3 for antibody 4192 (IGHV1-46)
AREKYYGSGTYPIDY

SEQ ID NO: 8385 - protein, 9 aa, Homo sapiens
  Light chain CDR3 for antibody 4193 (IGKV1-9)
QQLNSYPLT

SEQ ID NO: 8386 - protein, 15 aa, Homo sapiens
  Heavy chain CDR3 for antibody 4193 (IGHV1-46)
AREGVTGYYPNRIDP

SEQ ID NO: 8387 - protein, 9 aa, Homo sapiens
  Light chain CDR3 for antibody 4194 (IGKV1-9)
QQLNSYPFT

SEQ ID NO: 8388 - protein, 17 aa, Homo sapiens
  Heavy chain CDR3 for antibody 4194 (IGHV3-33)
ASEITVVRGENYYGMDV

SEQ ID NO: 8389 - protein, 9 aa, Homo sapiens
  Light chain CDR3 for antibody 4195 (IGKV1-9)
QQLNSYPYT

SEQ ID NO: 8390 - protein, 15 aa, Homo sapiens
  Heavy chain CDR3 for antibody 4195 (IGHV1-46)
AREKYYGAGSDPFDE

SEQ ID NO: 8391 - protein, 8 aa, Homo sapiens
  misc_feature (4)..(4): Xaa can be Val or Phe
  misc_feature (5)..(5): Xaa can be Ser or Thr
  misc_feature (6)..(6): Xaa can be Ser or Phe or Thr
  misc_feature (7)..(7): Xaa can be Asn or Ser or Tyr
  misc_feature (8)..(8): Xaa can be Tyr or Ala or Gly
GFTXXXXX

SEQ ID NO: 8392 - protein, 8 aa, Homo sapiens
  misc_feature (6)..(6): Xaa can be Ser or Phe
GFTVSXNY

SEQ ID NO: 8393 - protein, 8 aa, Homo sapiens
GFTFTSSA

SEQ ID NO: 8394 - protein, 8 aa, Homo sapiens
GFTFSSYG

SEQ ID NO: 8395 - protein, 8 aa, Homo sapiens
GFTVSSNY

SEQ ID NO: 8396 - protein, 8 aa, Homo sapiens
CFTVSTNY

SEQ ID NO: 8397 - protein, 7 aa, Homo sapiens
  misc_feature (2)..(4): Xaa can be any naturally occurring amino acid
  misc_feature (6)..(7): Xaa can be any naturally occurring amino acid
IXXXGXX

SEQ ID NO: 8398 - protein, 7 aa, Homo sapiens
  misc_feature (2)..(2): Xaa can be Tyr or Trp or Ser
  misc_feature (3)..(3): Xaa can be Ser or Gly or Tyr
  misc_feature (4)..(4): Xaa can be Gly or Ser or Asp
  misc_feature (6)..(6): Xaa can be Ser or Asn or Ser and Asn
  misc_feature (7)..(7): Xaa can be Thr or Lys
IXXXGXX

SEQ ID NO: 8399 - protein, 7 aa, Homo sapiens
IYSGGST

SEQ ID NO: 8400 - protein, 7 aa, Homo sapiens
IWGSGNT

SEQ ID NO: 8401 - protein, 8 aa, Homo sapiens
ISYDGSNK

SEQ ID NO: 8402 - protein, 7 aa, Homo sapiens
IYSGGST

SEQ ID NO: 8403 - protein, 7 aa, Homo sapiens
IYSGGST

SEQ ID NO: 8404 - protein, 12 aa, Homo sapiens
  misc_feature (5)..(5): Xaa can be Gly or Ser or Ala
  misc_feature (6)..(6): Xaa can be Pro or Ala or Ser
  misc_feature (7)..(7): Xaa can be Arg or Ala
  misc_feature (9)..(9): Xaa can be Gly or Tyr
  misc_feature (10)..(10): Xaa can be Ile or Phe
ARDLXXXGXXDY

SEQ ID NO: 8405 - protein, 16 aa, Homo sapiens
AAPYCSSTSCHDAFDI

SEQ ID NO: 8406 - protein, 16 aa, Homo sapiens
AKHGYSYGYWLGYFDY

SEQ ID NO: 8407 - protein, 12 aa, Homo sapiens
  misc_feature (3)..(3): Xaa can be Asp or Glu
  misc_feature (4)..(4): Xaa can be Cys or Thr or Leu
  misc_feature (5)..(5): Xaa can be Leu or Met
  misc_feature (6)..(6): Xaa can be Gly or Val
  misc_feature (7)..(7): Xaa can be Tyr or Ile
  misc_feature (8)..(8): Xaa can be Gly or Pro
ARXXXXXXSMDV

SEQ ID NO: 8408 - protein, 11 aa, Homo sapiens
ARGHWEYYFDY

SEQ ID NO: 8409 - protein, 8 aa, Homo sapiens
  misc_feature (4)..(8): Xaa can be any naturally occurring amino acid
GFTXXXXX

SEQ ID NO: 8410 - protein, 111 aa, Artificial Sequence
  Description of Artificial Sequence: Synthetic polypeptide
  MOD_RES (4)..(4): Ile or Val
  MOD_RES (19)..(19): Phe or Leu
  MOD_RES (20)..(20): Thr or Ile
  MOD_RES (21)..(21): Val or Phe
  MOD_RES (23)..(23): Ser or Phe
  MOD_RES (48)..(48): Ser or Asn
  MOD_RES (50)..(50): Phe or Tyr
  MOD_RES (52)..(52): Ala or Thr
  MOD_RES (91)..(91): Leu or Tyr
  MOD_RES (92)..(92): Gly or Ser or Ala
  MOD_RES (93)..(93): Pro or Ala
  MOD_RES (94)..(94): Arg or Ala
  MOD_RES (96)..(96): Gly or Tyr
  MOD_RES (97)..(97): Ile or Phe
  MOD_RES (98)..(98): Asp or Pro
GGLXQPGGSLRLSCAASGXXXSXNYMSWVRQAPGKGLEWVSVIYSGGXTXYXDSVKGRFTISRDNSKNTLYLQMNSLRAEDTAVYYCARDXXXXGXXXYWGQGTLVTVSSA

SEQ ID NO: 8411 - protein, 115 aa, Artificial Sequence
  Description of Artificial Sequence: Synthetic polypeptide
PEVKKPGTSVKVSCKASGFTFTSSAVQWVRQARGQRLEWIGWIWGSGNTNYAQKFQERVTITRDMSTSTAYMELSSLRSEDTAVYYCAAPYCSSTSCHDAFDIWGQGTMVTVSSA

SEQ ID NO: 8412 - protein, 116 aa, Artificial Sequence
  Description of Artificial Sequence: Synthetic polypeptide
GGVVQPGRSLRLSCAASGFTFSSYGMHWVRQAPGKGLEWVAVISYDGSNKYYADSVKGRFTISRDNSKNTLYLQMNSLRAEDTAVYYCAKHGYSYGYWLGYFDYWGQGTLVTVSSA

SEQ ID NO: 8413 - protein, 111 aa, Artificial Sequence
  Description of Artificial Sequence: Synthetic polypeptide
  MOD_RES (6)..(6): Pro or Thr
  MOD_RES (17)..(17): Ser or Thr
  MOD_RES (19)..(19): Phe or Val
  MOD_RES (21)..(21): Val or Phe
  MOD_RES (27)..(27): Ser or Asn
  MOD_RES (41)..(41): Ser or Leu
  MOD_RES (42)..(42): Val or Leu
  MOD_RES (50)..(50): Tyr or Phe
  MOD_RES (55)..(55): Val or Leu
  MOD_RES (64)..(64): Asp or His
  MOD_RES (90)..(90): Asp or Glu
  MOD_RES (91)..(91): Cys or Thr or Leu
  MOD_RES (92)..(92): Leu or Met
  MOD_RES (93)..(93): Gly or Val
  MOD_RES (94)..(94): Tyr or Ile
  MOD_RES (95)..(95): Gly or Pro
  MOD_RES (105)..(105): Thr or Met
GGLYQXGGSLRLSCAAXGXTXSSNYMXWVRQAPGKGLEWVXXIYSGGSTXYADSXKGRFTISRXNSKNTLYLQMNSLRAEDTAVYYCARXXXXXXSMDVWGQGTXVTVSSA

SEQ ID NO: 8414 - protein, 110 aa, Artificial Sequence
  Description of Artificial Sequence: Synthetic polypeptide
  MOD_RES (21)..(21): Val or Phe
  MOD_RES (23)..(23): Thr or Ser
  MOD_RES (49)..(49): Thr or Ala
  MOD_RES (56)..(56): Lys or Glu
  MOD_RES (61)..(61): Ile or Thr
  MOD_RES (82)..(82): Thr or Ala
  MOD_RES (86)..(86): Phe or Tyr
  MOD_RES (91)..(91): His or Asn
  MOD_RES (98)..(98): Tyr or His
  MOD_RES (101)..(101): Gln or Pro
  MOD_RES (104)..(104): Leu or Arg
  MOD_RES (110)..(110): Ser or Ala
GGLIQPGGSLRLSCAASGFTXSXNYMSWVRQAPGKGLEWVSVIYSGGSXFYADSVXGRFTXSRDNSKNTLYLQMNSLRAEDXAVYXCARGXWEYYFDXWGXGTXVTVSSX

SEQ ID NO: 8415 - protein, 116 aa, Artificial Sequence
  Description of Artificial Sequence: Synthetic polypeptide
GGLVQPGGSLRLSCAASGFTFSSYAMSWVRQAPGKGLEWVSAISGSGGSTYYADSVKGRFTISRDNSKNTLYLQMNSLRAEDTAVYYCAKEGMVLRYFDWLWDYWGQGTLVTVSSA

SEQ ID NO: 8416 - protein, 113 aa, Artificial Sequence
  Description of Artificial Sequence: Synthetic polypeptide
  MOD_RES (23)..(23): Ser or Asn
  MOD_RES (41)..(41): Ala or Thr
  MOD_RES (42)..(42): Val or Leu
  MOD_RES (44)..(44): Trp or Ser
  MOD_RES (48)..(48): Ser or Asn or Thr
  MOD_RES (69)..(69): Asn or Asp
  MOD_RES (91)..(91): Asp or Glu
  MOD_RES (92)..(92): Arg or Leu or Asn
  MOD_RES (93)..(93): Ser or Val or Leu
  MOD_RES (94)..(94): Ser or Asn or Leu
  MOD_RES (96)..(96): Pro or Trp or Thr
  MOD_RES (98)..(98): Gly or His or Tyr
GGVVQPGRSLRLSCAASGFTFSXYGMHWVRQAPGKGLEWVXXIXYDGXNKYYADSVKGRFTISRDNSKXTLYLQMNSLRAEDTAVYYCARXXXXGXSXFDYWGQGTLVTVSSA

SEQ ID NO: 8417 - protein, 112 aa, Artificial Sequence
  Description of Artificial Sequence: Synthetic polypeptide
  MOD_RES (5)..(5): Gln or Arg
  MOD_RES (8)..(8): Gly or Arg
  MOD_RES (35)..(35): Lys or Arg
  MOD_RES (42)..(42): Ala or Thr
  MOD_RES (90)..(90): Lys or Glu or Arg
  MOD_RES (91)..(91): Glu or Thr
  MOD_RES (92)..(92): Gln or Phe or Thr
  MOD_RES (93)..(93): Leu or Trp or Ile
  MOD_RES (94)..(94): Leu or Val or Trp
  MOD_RES (95)..(95): Gly or Leu
  MOD_RES (96)..(96): Val or Lys
  MOD_RES (97)..(97): Val or Pro or Leu
  MOD_RES (98)..(98): Phe or Leu or Asn
  MOD_RES (99)..(99): Asp or Asn
  MOD_RES (102)..(102): Gly or Val
GGLVXPGXSLRLSCAASGFTFSSYAMSWVRQAPGXGLEWVSXISGSGGSTYYADSVKGRFTISRDNSKNTLYLQMNSLRAEDTAVYYCAXXXXXXXXXXYWXQGTLVTVSSA

SEQ ID NO: 8418 - protein, 115 aa, Artificial Sequence
  Description of Artificial Sequence: Synthetic polypeptide
  MOD_RES (2)..(2): Gly or Val
  MOD_RES (3)..(3): Val or Leu
  MOD_RES (20)..(20): Thr or Asn
  MOD_RES (24)..(24): Tyr or His
  MOD_RES (27)..(27): Ser or Asn
  MOD_RES (32)..(32): Ala or Val
  MOD_RES (48)..(48): Gly or Asp
  MOD_RES (83)..(83): Thr or Ser
  MOD_RES (91)..(91): Asp or Asn
  MOD_RES (92)..(92): Arg or Gly
  MOD_RES (95)..(95): Ser or Thr
  MOD_RES (96)..(96): Gly or Ser or Trp or Phe
  MOD_RES (97)..(97): Trp or Phe or Tyr
  MOD_RES (98)..(98): Arg or Phe or Tyr or Asn
  MOD_RES (100)..(100): Trp or Ala
  MOD_RES (103)..(103): Pro or Ile
  MOD_RES (108)..(108): Thr or Ala
  MOD_RES (109)..(109): Leu or Met
GXXVRPGGSLRLSCAASGFXFDDXGMXWVRQXPGKGLEWVSGINWNGXSTGYADSVKGRFTISRDNAKNSLYLQMNSLRAEDXALYHCARXXGSXXXXDXFDXWGQGXXVTVSSA

SEQ ID NO: 8419 - protein, 113 aa, Artificial Sequence
  Description of Artificial Sequence: Synthetic polypeptide
  MOD_RES (24)..(24): Tyr or Asp
  MOD_RES (25)..(25): Tyr or Phe or Leu
  MOD_RES (27)..(27): Ser or Cys
  MOD_RES (29)..(29): Ile or Val
  MOD_RES (41)..(41): Ser or Ala
  MOD_RES (48)..(48): Ser or Tyr
  MOD_RES (62)..(62): Thr or Ile
  MOD_RES (76)..(76): Ser or Asn
  MOD_RES (95)..(95): Arg or Ser
  MOD_RES (98)..(98): Val or Asn
  MOD_RES (101)..(101): Thr or Asn or Ser
GGLVKPGGSLRLSCAASGFTFSDXXMXWXRQAPGKGLEWVXYISGSGXTIYYADSVKGRFTXSRDNAKNSLYLQMXSLRAEDTAVYYCARDEGYXGYXLDXWGQGTLVTVSSA

SEQ ID NO: 8420 - protein, 106 aa, Artificial Sequence
  Description of Artificial Sequence: Synthetic polypeptide
  MOD_RES (16)..(16): Thr or Ala
  MOD_RES (19)..(19): Phe or Leu
  MOD_RES (23)..(23): Ser or Thr
  MOD_RES (26)..(26): Met or Ile
  MOD_RES (42)..(42): Asn or His
  MOD_RES (44)..(44): Asn or Asp
  MOD_RES (48)..(48): Ser or Thr
  MOD_RES (49)..(49): Val or Ala
  MOD_RES (51)..(51): Tyr or His
  MOD_RES (97)..(97): Gln or Arg
GGLVQPGGSLRLSCAXSGXTFSXHWXDWVRQAPGKGLEWVAXIXQDGXXIXYVDSVKGRFTISRDNTKNSLYLQMNSLRAEDTAVYYCTRALDYWGXGTLVTVSSA

SEQ ID NO: 8421 - protein, 119 aa, Artificial Sequence
  Description of Artificial Sequence: Synthetic polypeptide
  MOD_RES (2)..(2): Glu or Gly
  MOD_RES (10)..(10): Val or Met
  MOD_RES (11)..(11): Lys or Arg
  MOD_RES (26)..(26): Phe or Leu
  MOD_RES (39)..(39): Trp or Gly
  MOD_RES (40)..(40): Met or Val
  MOD_RES (80)..(80): Ser or Tyr
  MOD_RES (100)..(100): Pro or Thr
  MOD_RES (106)..(106): Asp or Gly
  MOD_RES (115)..(115): Thr or Ala
AXVKRPGASXXVSCKAPGDTFTNFGXSWVRQAPGHGLEXXGWINAYNDNTNYTQKFQDRVTMTTDTSTSTAYMELRSLRXDDTAVYFCARVSARRILTAXRYPLIXSWGQGTLVXVSSA

SEQ ID NO: 8422 - protein, 115 aa, Artificial Sequence
  Description of Artificial Sequence: Synthetic polypeptide
  MOD_RES (12)..(12): Ile or Thr
  MOD_RES (15)..(15): Lys or Arg
  MOD_RES (21)..(21): Phe or Leu
  MOD_RES (26)..(26): Ile or Val
  MOD_RES (35)..(35): Lys or Arg
  MOD_RES (60)..(60): Val or Ala
  MOD_RES (77)..(77): Ser or Gly
AEVKKPGESLRXSCXGSGYSXTSFWXSWVRQMPGXGLEWMGKIDPSDSDTRYSPSLEGHXTMSVDTSTNTTYLQWRXLKASDTAIYYCARHMARDSIGYYHDFWGQGILVTVSSA

SEQ ID NO: 8423 - protein, 115 aa, Artificial Sequence
  Description of Artificial Sequence: Synthetic polypeptide
  MOD_RES (9)..(9): Ser or Leu
  MOD_RES (14)..(14): Cys or Tyr
  MOD_RES (20)..(20): Thr or Ala
  MOD_RES (38)..(38): Glu or Gly
  MOD_RES (55)..(55): Asn or Asp
  MOD_RES (65)..(65): Asp or Gly
GEVKKPGAXVKVSXKTSGYXFISYDITWVRQAPGQGLXWMGSISAYYRNASYAQXVQDRVTMTTXTSTSTAYMELKSLKSDDTAVYYCARVRYPISADNRWDHWGQGTLVTVSSA

SEQ ID NO: 8424 - protein, 109 aa, Artificial Sequence
  Description of Artificial Sequence: Synthetic polypeptide
  MOD_RES (17)..(17): Tyr or Cys
  MOD_RES (31)..(31): Gln or His
  MOD_RES (33)..(33): Pro or Ser
  MOD_RES (44)..(44): Asn or Ser
  MOD_RES (60)..(60): Thr or Ile
  MOD_RES (103)..(103): Leu or Pro
AEVEKPGASVKVSCKAXGYTFTDYYIHWVRXAXGQGLEWLGRIXPTTGTIYAQKFQDRVXLTSDTSINTAYMELSSLTFDDTTAVYYCGRGVRSFNPWGQGTXVTVSSA

SEQ ID NO: 8425 - protein, 112 aa, Artificial Sequence
  Description of Artificial Sequence: Synthetic polypeptide
GGLVQPGGSLRLSCAASGFNFDMSWMGWVRQAPGKGLEWVANIKPDGSERHYADSVKGRFTISRDNPKKSLFLQLDSLTGEDTALYYCARDGGRYGDFDYWGQGTLVTVSSA

SEQ ID NO: 8426 - protein, 116 aa, Artificial Sequence
  Description of Artificial Sequence: Synthetic polypeptide
  MOD_RES (23)..(23): Ile or Thr
  MOD_RES (29)..(29): Asn or Ser
  MOD_RES (31)..(31): Ile or Thr
  MOD_RES (53)..(53): Asn or Thr
  MOD_RES (57)..(57): Val or Leu
  MOD_RES (60)..(60): Val or Met
  MOD_RES (75)..(75): Phe or Leu
  MOD_RES (80)..(80): Asn or Arg
  MOD_RES (84)..(84): Pro or Thr
  MOD_RES (87)..(87): Thr or Pro
  MOD_RES (88)..(88): Ala or Thr
  MOD_RES (110)..(110): Met or Thr
PGLVKPSQTLSLTCAISGDSVSXNSGAWXWXRQSPSRGLEWLGRTYYNSKWYXDYAXSVXKSRITINPDTSKNQXSLQLXSVTXEDXXVYYCARLDWNYRAFDIWGQGTXVTVSSA

SEQ ID NO: 8427 - protein, 109 aa, Artificial Sequence
  Description of Artificial Sequence: Synthetic polypeptide
  MOD_RES (3)..(3): Leu or Val
  MOD_RES (5)..(5): Gln or Arg
  MOD_RES (12)..(12): Leu or Pro
  MOD_RES (13)..(13): Ala or Ser
  MOD_RES (17)..(17): Ser or Pro
  MOD_RES (22)..(22): Ser or Arg
  MOD_RES (24)..(24): His or Tyr or Asn
  MOD_RES (25)..(25): Tyr or Met
  MOD_RES (44)..(44): Met or Lys
  MOD_RES (45)..(45): Gln or Arg
  MOD_RES (49)..(49): Gln or Glu
  MOD_RES (51)..(51): Ser or Phe or Val
  MOD_RES (54)..(54): Asp or Asn
  MOD_RES (56)..(56): Val or Met
  MOD_RES (59)..(59): Arg or Met
  MOD_RES (60)..(60): Phe or Leu
  MOD_RES (62)..(62): Ile or Thr
  MOD_RES (68)..(68): Asp or Lys
  MOD_RES (71)..(71): Leu or Val
  MOD_RES (72)..(72): Tyr or Phe
  MOD_RES (74)..(74): Gln or Glu
  MOD_RES (77)..(77): Ser or Asn
  MOD_RES (97)..(97): Ser or Tyr
  MOD_RES (102)..(102): Thr or Ala
  MOD_RES (105)..(105): Thr or Ala
  MOD_RES (106)..(106): Val or Ala
  MOD_RES (108)..(108): Ser or Pro
GGXVXPGGSLRXXCAAXGFTFXSXXMGWVRQAPGKGLEWVANIXXDGSXKXYVXSXKGXXTXSRDNAXNSXXLXMNXLRAEDTAVYYCGSRRPYFDXWGQGXLVXXSXA

SEQ ID NO: 8428 - protein, 109 aa, Artificial Sequence
  Description of Artificial Sequence: Synthetic polypeptide
  MOD_RES (7)..(7): Gly or Arg
  MOD_RES (9)..(9): Ser or Pro
  MOD_RES (14)..(14): Cys or Arg
  MOD_RES (15)..(15): Val or Ala
  MOD_RES (16)..(16): Gly or Ala
  MOD_RES (22)..(22): Ser or Asn
  MOD_RES (26)..(26): Met or Val
  MOD_RES (43)..(43): Ile or Thr
  MOD_RES (45)..(45): Pro or Gln
  MOD_RES (52)..(52): Tyr or Met
  MOD_RES (63)..(63): Ser or Pro
  MOD_RES (77)..(77): Leu or Met
  MOD_RES (84)..(84): Val or Met
  MOD_RES (93)..(93): Arg or Gln
  MOD_RES (102)..(102): Thr or Ala
GGLVQPXGXLRLSXXXSGFTFXNYWXSWVRQAPGKGLEWVANXKXDEGEKYXVDSVKGRFTIXRDNAKNSLYLQMNXRAEDTAXYFCARRWEXYFDYWGQGXLVTVSSA

SEQ ID NO: 8429 - protein, 112 aa, Artificial Sequence
  Description of Artificial Sequence: Synthetic polypeptide
  MOD_RES (5)..(5): Gln or Arg
  MOD_RES (6)..(6): Pro or Asn
  MOD_RES (14)..(14): Cys or Arg
  MOD_RES (19)..(19): Phe or Leu
  MOD_RES (20)..(20): Thr or Ala
  MOD_RES (28)..(28): Trp or Arg
  MOD_RES (32)..(32): Thr or Ser
  MOD_RES (42)..(42): Arg or Asn
  MOD_RES (47)..(47): Pro or Leu or Ser
  MOD_RES (53)..(53): Glu or Gly
  MOD_RES (54)..(54): Tyr or Cys
  MOD_RES (60)..(60): Gly or Asp
  MOD_RES (62)..(62): Phe or Ser
  MOD_RES (68)..(68): Asp or Gly
  MOD_RES (77)..(77): Met or Thr
  MOD_RES (78)..(78): Asn or Asp
  MOD_RES (80)..(80): Leu or Pro or Met
  MOD_RES (83)..(83): Asp or Gly
  MOD_RES (84)..(84): Asp or Gly
  MOD_RES (94)..(94): Arg or Asn
  MOD_RES (97)..(97): Phe or Leu
  MOD_RES (107)..(107): Val or Ala
  MOD_RES (111)..(111): Ser or Pro
  MOD_RES (112)..(112): Ala or Thr
GGLVXXGGSLRLSXAASGXXFSDYFMDXVRQXPDKGLEWIGXIRNKXNRYTTXXAASVKXRXSVSRDXSKNSLYLQXXSXKTXXTAVYYCCRDXEGXGDVWGQGTTXTVSXX

SEQ ID NO: 8430 - protein, 116 aa, Artificial Sequence
  Description of Artificial Sequence: Synthetic polypeptide
  MOD_RES (90)..(90): Any amino acid
  MOD_RES (94)..(94): Tyr or Gly
  MOD_RES (96)..(96): Ser or Thr
  MOD_RES (100)..(100): Any amino acid
  MOD_RES (101)..(101): Any amino acid
  MOD_RES (104)..(104): Tyr or Val
  MOD_RES (110)..(110): Leu or Thr
GGVVQPGRSLRLSCAASGFTFSSYGMHWVRQAPGKGLEWVAVIWYDGSNKYYADSVKGRFTISRDNSKNTLYLQMNSLRAEDTAVYYCRXGGYXGXGSLXXFDXWGQGTXVTVSSA

SEQ ID NO: 8431 - protein, 110 aa, Artificial Sequence
  Description of Artificial Sequence: Synthetic polypeptide
PGLVKPSETLSLTCTFSGGSISYYYWSWIRQPPGKGLEWIGYIYYSGSTNYNPSLKSRVTMSVDTSKNQFSLKLSSVTAADTAVYYCTRETLERGFDYWGQGTLVTVSSA

SEQ ID NO: 8432 - protein, 113 aa, Artificial Sequence
  Description of Artificial Sequence: Synthetic polypeptide
  MOD_RES (23)..(23): Ser or Asn
  MOD_RES (75)..(75): Ser or Thr
  MOD_RES (90)..(90): Lys or Ala
  MOD_RES (91)..(91): Val or Arg
  MOD_RES (92)..(92): Ala or Asn
  MOD_RES (93)..(93): Any amino acid
  MOD_RES (94)..(94): Any amino acid
  MOD_RES (95)..(95): Gly or Arg
  MOD_RES (96)..(96): Tyr or Thr or Gly
  MOD_RES (97)..(97): Trp or Arg
  MOD_RES (99)..(99): Phe or Leu
  MOD_RES (101)..(101): Leu or Tyr or Pro
  MOD_RES (104)..(104): Arg or Gln
PGLVKPSETLSLTCTVSGGSISXYYWSWIRQPPGKGLEWIGYIYYSGSTNYNPSLKSRVTISVDTSKNQFSLKLXSVTAADTAVYYCARXXXXXXXXYXDXWGXGTLVTVSSA

SEQ ID NO: 8433 - protein, 115 aa, Artificial Sequence
  Description of Artificial Sequence: Synthetic polypeptide
AEVKKPGASVKVSCKASGYTFTSYYMHWVRQAPGQGLEWMGIINPSGGSTSYAQKFQGRVTMTRDTSTSTVYMELSSLRSEDTAVYYCARAPLLLWFGEFIDYWGQGTLVTVSSA

SEQ ID NO: 8434 - protein, 121 aa, Artificial Sequence
  Description of Artificial Sequence: Synthetic polypeptide
  MOD_RES (20)..(20): Thr or Pro
  MOD_RES (26)..(26): Met or Thr
  MOD_RES (43)..(43): Ile or Lys
  MOD_RES (44)..(44): Trp or Phe or Ser
  MOD_RES (45)..(45): Tyr or Phe
  MOD_RES (48)..(48): Ser or Asn
  MOD_RES (51)..(51): Tyr or Phe
  MOD_RES (53)..(53): Ala or Thr
  MOD_RES (62)..(62): Ile or Thr
  MOD_RES (69)..(69): Asn or Asp
  MOD_RES (91)..(91): Asp or Glu
  MOD_RES (94)..(94): Arg or Tyr
  MOD_RES (95)..(95): Tyr or Asn
  MOD_RES (96)..(96): Asp or Ser
  MOD_RES (102)..(102): Gly or Trp
  MOD_RES (103)..(103): Gly or Asn
  MOD_RES (104)..(104): Any amino acid
  MOD_RES (105)..(105): Any amino acid
  MOD_RES (106)..(106): Ala or Tyr
  MOD_RES (107)..(107): Phe or Pro or Leu
GGVVQPGRSLRLSCAASGFXFSSYGXHWVRQAPGKGLEWVAVXXXDGXNKXYXDSVKGRFTXSRDNSKXTLYLQMNSLRAEDTAVYYCARXAKXXXILTGYXXXXXXDYWGQGTLVTVSSA

The invention claimed is:

1. A pharmaceutical composition comprising:
    a mixture of at least 100 unique human recombinant antibodies specifically binding to SARS-CoV-2 receptor binding domain (RBD) or SARS-CoV-2 spike S1, wherein the mixture has an EC50 lower than 0.001 mg/ml,
    a pharmaceutically acceptable excipient, and
    a compound selected from benzalkonium chloride, benzyl alcohol, benzoic acid, salicylic acid, thimerosal, phenethyl alcohol, methylparaben, propylparaben, chlorhexidine, sorbic acid and hydrogen peroxide in an amount effective to preserve the pharmaceutical composition,
    wherein the mixture of at least 100 unique human recombinant antibodies has been generated by the process of
    a. isolating single cells from a blood sample from a human donor exposed to an antigen of SARS CoV-2;
    b. amplifying polynucleotides, wherein each of the polynucleotides encodes a cognate pair of heavy chain and light chain variable regions from one of the single cells by overlap extension reverse transcriptase polymerase chain reaction (OE-RT-PCR);
    c. cloning the polynucleotides obtained from the amplification into expression vectors, thereby obtaining constructs encoding antibody fragments;
    d. expressing the antibody fragments from the constructs;
    e. enriching a subset of the constructs based on the binding activities of the antibody fragments against SAR-CoV-2 RBD or SAR-CoV-2 spike S1;
    f. generating antibody expression constructs using the subset of the constructs of step e, wherein each of the antibody expression constructs encodes a light chain variable region, a kappa or lambda-type light chain constant region, a heavy chain variable region, and a heavy chain IgG constant region,
    g. introducing the antibody expression constructs of step f into a cell line, and
    h. expressing antibodies from the antibody expression constructs in the cell line, thereby obtaining the at least 100 unique human recombinant antibodies;
    wherein each of the at least 100 unique human recombinant antibodies is an IgG antibody comprising a cognate pair of heavy chain and light chain variable regions; and
    wherein each of the cognate pair of heavy chain and light chain variable regions comprises a heavy chain variable region and a light chain variable region from a single cell out of the blood sample.

2. The pharmaceutical composition of claim 1, wherein the mixture has at least 100-fold lower EC50 against a SARS-CoV-2 receptor binding domain (RBD) or SARS-CoV-2 spike S1 compared to a plasma sample from the donor exposed to the antigen of SARS CoV-2.

3. The pharmaceutical composition of claim 2, wherein the mixture has at least 300-fold lower EC50 against a SARS-CoV-2 receptor binding domain (RBD) or SARS-CoV-2 spike S1 compared to a plasma sample from the donor exposed to the antigen of SARS CoV-2.

4. The pharmaceutical composition of claim 3, wherein the mixture has at least 500-fold lower EC50 against a SARS-CoV-2 receptor binding domain (RBD) or SARS-CoV-2 spike S1 compared to a plasma sample from the donor exposed to the antigen of SARS CoV-2.

5. The pharmaceutical composition of claim 1, wherein the EC50 is measured by anti-SARS-CoV-2-ELISA.

6. The pharmaceutical composition of claim 1, wherein each of the recombinant antibodies is a human IgG1 subtype.

7. The pharmaceutical composition of claim 1, wherein each of the recombinant antibodies has been enriched based on neutralization activity against SARS-CoV-2.

8. The pharmaceutical composition of claim 1, wherein the mixture comprises at least 1000 recombinant antibodies specifically binding to SARS-CoV-2 receptor binding domain (RBD) or SARS-CoV-2 spike S1.

9. The pharmaceutical composition of claim 1, wherein the mixture comprises at least 10,000 recombinant antibodies specifically binding to SARS-CoV-2 receptor binding domain (RBD) or SARS-CoV-2 spike S1.

10. The pharmaceutical composition of claim 1, wherein the antibody fragments are single-chain variable fragments (scFvs).

* * * * *